United States Patent 12,508,308 (INFLUENZA mRNA VACCINES) - sequence listing, part 25

SEQ ID NO: 93307 - RNA, 1701 nt, Artificial Sequence
  derived and/or modified sequence opt2 from hemagglutinin__InfluenzaA__ABU92646
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93308 - RNA, 1701 nt, Artificial Sequence; identical to SEQ ID NO: 91585
  derived and/or modified sequence opt2 from hemagglutinin__InfluenzaA__ABU92647

SEQ ID NO: 93309 - RNA, 1701 nt, Artificial Sequence
  derived and/or modified sequence opt2 from hemagglutinin__InfluenzaA__ABU92648
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93310 - RNA, 1701 nt, Artificial Sequence; identical to SEQ ID NO: 91585
  derived and/or modified sequence opt2 from hemagglutinin__InfluenzaA__ABU92649

SEQ ID NO: 93311 - RNA, 1701 nt, Artificial Sequence; identical to SEQ ID NO: 93274
  derived and/or modified sequence opt2 from hemagglutinin__InfluenzaA__ABU92650

SEQ ID NO: 93312 - RNA, 1701 nt, Artificial Sequence
  derived and/or modified sequence opt2 from hemagglutinin__InfluenzaA__ABU92651
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucuacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93313 - RNA, 1701 nt, Artificial Sequence
  derived and/or modified sequence opt2 from hemagglutinin__InfluenzaA__ABU92652
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93314 - RNA, 1701 nt, Artificial Sequence; identical to SEQ ID NO: 93274
  derived and/or modified sequence opt2 from hemagglutinin__InfluenzaA__ABU92653

SEQ ID NO: 93315 - RNA, 1701 nt, Artificial Sequence
  derived and/or modified sequence opt2 from hemagglutinin__InfluenzaA__ABU92654
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggcaagaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccucaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacgccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93316 - RNA, 1701 nt, Artificial Sequence
  derived and/or modified sequence opt2 from hemagglutinin__InfluenzaA__ABU92655
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacgccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93317 - RNA, 1701 nt, Artificial Sequence; identical to SEQ ID NO: 93274
  derived and/or modified sequence opt2 from hemagglutinin__InfluenzaA__ABU92656

SEQ ID NO: 93318 - RNA, 1701 nt, Artificial Sequence; identical to SEQ ID NO: 92145
  derived and/or modified sequence opt2 from hemagglutinin__InfluenzaA__ABU92657

SEQ ID NO: 93319 - RNA, 1701 nt, Artificial Sequence; identical to SEQ ID NO: 93274
  derived and/or modified sequence opt2 from hemagglutinin__InfluenzaA__ABU92658

SEQ ID NO: 93320 - RNA, 1701 nt, Artificial Sequence; identical to SEQ ID NO: 92145
  derived and/or modified sequence opt2 from hemagglutinin__InfluenzaA__ABU92659

SEQ ID NO: 93321 - RNA, 1701 nt, Artificial Sequence; identical to SEQ ID NO: 93274
  derived and/or modified sequence opt2 from hemagglutinin__InfluenzaA__ABU92660

SEQ ID NO: 93322 - RNA, 1701 nt, Artificial Sequence
  derived and/or modified sequence opt2 from hemagglutinin__InfluenzaA__ABU92661
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucgaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93323 - RNA, 1701 nt, Artificial Sequence; identical to SEQ ID NO: 91585
  derived and/or modified sequence opt2 from hemagglutinin__InfluenzaA__ABU92662

SEQ ID NO: 93324 - RNA, 1701 nt, Artificial Sequence; identical to SEQ ID NO: 93274
  derived and/or modified sequence opt2 from hemagglutinin__InfluenzaA__ABU92663

SEQ ID NO: 93325 - RNA, 1701 nt, Artificial Sequence; identical to SEQ ID NO: 93274
  derived and/or modified sequence opt2 from hemagglutinin__InfluenzaA__ABU92664

SEQ ID NO: 93326 - RNA, 1701 nt, Artificial Sequence
  derived and/or modified sequence opt2 from hemagglutinin__InfluenzaA__ABU92665
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucacccagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93327 - RNA, 1701 nt, Artificial Sequence; identical to SEQ ID NO: 93274
  derived and/or modified sequence opt2 from hemagglutinin__InfluenzaA__ABU92666

SEQ ID NO: 93328 - RNA, 1701 nt, Artificial Sequence; identical to SEQ ID NO: 91584
  derived and/or modified sequence opt2 from hemagglutinin__InfluenzaA__ABU92667

SEQ ID NO: 93329 - RNA, 1701 nt, Artificial Sequence; identical to SEQ ID NO: 91584
  derived and/or modified sequence opt2 from hemagglutinin__InfluenzaA__ABU92668

SEQ ID NO: 93330 - RNA, 1701 nt, Artificial Sequence
  derived and/or modified sequence opt2 from hemagglutinin__InfluenzaA__ABU92669
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcaacggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93331 - RNA, 1701 nt, Artificial Sequence; identical to SEQ ID NO: 91584
  derived and/or modified sequence opt2 from hemagglutinin__InfluenzaA__ABU92670

SEQ ID NO: 93332 - RNA, 1701 nt, Artificial Sequence
  derived and/or modified sequence opt2 from hemagglutinin__InfluenzaA__ABU92671
augaagaccaucaucgcccucucccacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacaucccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggccgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93333 - RNA, 1701 nt, Artificial Sequence; identical to SEQ ID NO: 91584
  derived and/or modified sequence opt2 from hemagglutinin__InfluenzaA__ABU92672

SEQ ID NO: 93334 - RNA, 1701 nt, Artificial Sequence; identical to SEQ ID NO: 91584
  derived and/or modified sequence opt2 from hemagglutinin__InfluenzaA__ABU92673

SEQ ID NO: 93335 - RNA, 1701 nt, Artificial Sequence
  derived and/or modified sequence opt2 from hemagglutinin__InfluenzaA__ABU92674
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgccgcaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93336 - RNA, 1701 nt, Artificial Sequence
  derived and/or modified sequence opt2 from hemagglutinin__InfluenzaA__ABU92675
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaugggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93337 - RNA, 1701 nt, Artificial Sequence; identical to SEQ ID NO: 92145
  derived and/or modified sequence opt2 from hemagglutinin__InfluenzaA__ABU92676

SEQ ID NO: 93338 - RNA, 1701 nt, Artificial Sequence; identical to SEQ ID NO: 93265
  derived and/or modified sequence opt2 from hemagglutinin__InfluenzaA__ABU92677

SEQ ID NO: 93339 - RNA, 1701 nt, Artificial Sequence
  derived and/or modified sequence opt2 from hemagglutinin__InfluenzaA__ABU92678
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93340 - RNA, 1701 nt, Artificial Sequence
  derived and/or modified sequence opt2 from hemagglutinin__InfluenzaA__ABU92680
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93341 - RNA, 1701 nt, Artificial Sequence; identical to SEQ ID NO: 93269
  derived and/or modified sequence opt2 from hemagglutinin__InfluenzaA__ABU92681

SEQ ID NO: 93342 - RNA, 1701 nt, Artificial Sequence; identical to SEQ ID NO: 91585
  derived and/or modified sequence opt2 from hemagglutinin__InfluenzaA__ABU92682

SEQ ID NO: 93343 - RNA, 1701 nt, Artificial Sequence; identical to SEQ ID NO: 93274
  derived and/or modified sequence opt2 from hemagglutinin__InfluenzaA__ABU92683

SEQ ID NO: 93344 - RNA, 1701 nt, Artificial Sequence
  derived and/or modified sequence opt2 from hemagglutinin__InfluenzaA__ABU92684
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggcccccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93345 - RNA, 1701 nt, Artificial Sequence
  derived and/or modified sequence opt2 from hemagglutinin__InfluenzaA__ABU92685
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93346 - RNA, 1701 nt, Artificial Sequence; identical to SEQ ID NO: 93274
  derived and/or modified sequence opt2 from hemagglutinin__InfluenzaA__ABU92686

SEQ ID NO: 93347 - RNA, 1701 nt, Artificial Sequence; identical to SEQ ID NO: 93274
  derived and/or modified sequence opt2 from hemagglutinin__InfluenzaA__ABU92687

SEQ ID NO: 93348 - RNA, 1701 nt, Artificial Sequence; identical to SEQ ID NO: 93307
  derived and/or modified sequence opt2 from hemagglutinin__InfluenzaA__ABU92688

SEQ ID NO: 93349 - RNA, 1701 nt, Artificial Sequence; identical to SEQ ID NO: 93274
  derived and/or modified sequence opt2 from hemagglutinin__InfluenzaA__ABU92689

SEQ ID NO: 93350 - RNA, 1701 nt, Artificial Sequence
  derived and/or modified sequence opt2 from hemagglutinin__InfluenzaA__ABU92691
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaucggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93351 - RNA, 1701 nt, Artificial Sequence; identical to SEQ ID NO: 92202
  derived and/or modified sequence opt2 from hemagglutinin__InfluenzaA__ABU92692

SEQ ID NO: 93352 - RNA, 1701 nt, Artificial Sequence
  derived and/or modified sequence opt2 from hemagglutinin__InfluenzaA__ABU92693
augaaggccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93353 - RNA, 1701 nt, Artificial Sequence
  derived and/or modified sequence opt2 from hemagglutinin__InfluenzaA__ABU92694
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93354 - RNA, 1701 nt, Artificial Sequence; identical to SEQ ID NO: 93265
  derived and/or modified sequence opt2 from hemagglutinin__InfluenzaA__ABU92695

SEQ ID NO: 93355 - RNA, 1701 nt, Artificial Sequence
  derived and/or modified sequence opt2 from hemagglutinin__InfluenzaA__ABU92696
augaagaccaucaucgcccucggcuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93356 - RNA, 1701 nt, Artificial Sequence; identical to SEQ ID NO: 92145
  derived and/or modified sequence opt2 from hemagglutinin__InfluenzaA__ABU92697

SEQ ID NO: 93357 - RNA, 1701 nt, Artificial Sequence; identical to SEQ ID NO: 91755
  derived and/or modified sequence opt2 from hemagglutinin__InfluenzaA__ABU92698

SEQ ID NO: 93358 - RNA, 1701 nt, Artificial Sequence
  derived and/or modified sequence opt2 from hemagglutinin__InfluenzaA__ABU92699
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93359 - RNA, 1701 nt, Artificial Sequence
  derived and/or modified sequence opt2 from hemagglutinin__InfluenzaA__ABU92700
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagcgcuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93360 - RNA, 1701 nt, Artificial Sequence
  derived and/or modified sequence opt2 from hemagglutinin__InfluenzaA__ABU92701
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagcgcuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgccuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93361 - RNA, 1701 nt, Artificial Sequence; identical to SEQ ID NO: 92124
  derived and/or modified sequence opt2 from hemagglutinin__InfluenzaA__ABU92702

SEQ ID NO: 93362 - RNA, 1701 nt, Artificial Sequence; identical to SEQ ID NO: 93340
  derived and/or modified sequence opt2 from hemagglutinin__InfluenzaA__ABU92703

SEQ ID NO: 93363 - RNA, 1701 nt, Artificial Sequence
  derived and/or modified sequence opt2 from hemagglutinin__InfluenzaA__ABU92704
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93364 - RNA, 1701 nt, Artificial Sequence
  derived and/or modified sequence opt2 from hemagglutinin__InfluenzaA__ABU92705
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccgcaucaaguccgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93365 - RNA, 1701 nt, Artificial Sequence; identical to SEQ ID NO: 91585
  derived and/or modified sequence opt2 from hemagglutinin__InfluenzaA__ABU92706

SEQ ID NO: 93366 - RNA, 1701 nt, Artificial Sequence; identical to SEQ ID NO: 93274
  derived and/or modified sequence opt2 from hemagglutinin__InfluenzaA__ABU92707

SEQ ID NO: 93367 - RNA, 1701 nt, Artificial Sequence; identical to SEQ ID NO: 93274
  derived and/or modified sequence opt2 from hemagglutinin__InfluenzaA__ABU92708

SEQ ID NO: 93368 - RNA, 1701 nt, Artificial Sequence
  derived and/or modified sequence opt2 from hemagglutinin__InfluenzaA__ABU92709
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93369 - RNA, 1701 nt, Artificial Sequence; identical to SEQ ID NO: 91563
  derived and/or modified sequence opt2 from hemagglutinin__InfluenzaA__ABU92710

SEQ ID NO: 93370 - RNA, 1701 nt, Artificial Sequence; identical to SEQ ID NO: 91585
  derived and/or modified sequence opt2 from hemagglutinin__InfluenzaA__ABU92711

SEQ ID NO: 93371 - RNA, 1701 nt, Artificial Sequence; identical to SEQ ID NO: 91585
  derived and/or modified sequence opt2 from hemagglutinin__InfluenzaA__ABU92712

SEQ ID NO: 93372 - RNA, 1701 nt, Artificial Sequence; identical to SEQ ID NO: 93274
  derived and/or modified sequence opt2 from hemagglutinin__InfluenzaA__ABU92713

SEQ ID NO: 93373 - RNA, 1701 nt, Artificial Sequence; identical to SEQ ID NO: 93274
  derived and/or modified sequence opt2 from hemagglutinin__InfluenzaA__ABU92714

SEQ ID NO: 93374 - RNA, 1701 nt, Artificial Sequence
  derived and/or modified sequence opt2 from hemagglutinin__InfluenzaA__ABU92715
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgagaagcucuacaucuggggcguccaccaccccggcaccgacuccgaccagaucaaccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93375 - RNA, 1701 nt, Artificial Sequence; identical to SEQ ID NO: 93274
  derived and/or modified sequence opt2 from hemagglutinin__InfluenzaA__ABU92716

SEQ ID NO: 93376 - RNA, 1701 nt, Artificial Sequence; identical to SEQ ID NO: 93274
  derived and/or modified sequence opt2 from hemagglutinin__InfluenzaA__ABU92717

SEQ ID NO: 93377 - RNA, 1701 nt, Artificial Sequence; identical to SEQ ID NO: 91585
  derived and/or modified sequence opt2 from hemagglutinin__InfluenzaA__ABU92718

SEQ ID NO: 93378 - RNA, 1701 nt, Artificial Sequence; identical to SEQ ID NO: 91585
  derived and/or modified sequence opt2 from hemagglutinin__InfluenzaA__ABU92719

SEQ ID NO: 93379 - RNA, 1701 nt, Artificial Sequence
  derived and/or modified sequence opt2 from hemagglutinin__InfluenzaA__ABU92720
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacuccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93380 - RNA, 1701 nt, Artificial Sequence
  derived and/or modified sequence opt2 from hemagglutinin__InfluenzaA__ABU92721
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucacccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93381 - RNA, 1701 nt, Artificial Sequence; identical to SEQ ID NO: 93265
  derived and/or modified sequence opt2 from hemagglutinin__InfluenzaA__ABU92722

SEQ ID NO: 93382 - RNA, 1701 nt, Artificial Sequence; identical to SEQ ID NO: 91585
  derived and/or modified sequence opt2 from hemagglutinin__InfluenzaA__ABU92723

SEQ ID NO: 93383 - RNA, 1701 nt, Artificial Sequence; identical to SEQ ID NO: 93368
  derived and/or modified sequence opt2 from hemagglutinin__InfluenzaA__ABU92724

SEQ ID NO: 93384 - RNA, 1701 nt, Artificial Sequence
  derived and/or modified sequence opt2 from hemagglutinin__InfluenzaA__ABU92725
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucaaccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgaccuccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93385 - RNA, 1701 nt, Artificial Sequence; identical to SEQ ID NO: 93368
  derived and/or modified sequence opt2 from hemagglutinin__InfluenzaA__ABU92726

SEQ ID NO: 93386 - RNA, 1701 nt, Artificial Sequence
  derived and/or modified sequence opt2 from hemagglutinin__InfluenzaA__ABU92727
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggacuucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93387 - RNA, 1701 nt, Artificial Sequence
  derived and/or modified sequence opt2 from hemagglutinin__InfluenzaA__ABU92728
augaagaccaucaucgcccucuccuacauccucugccaggucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93388 - RNA, 1701 nt, Artificial Sequence; identical to SEQ ID NO: 93387
  derived and/or modified sequence opt2 from hemagglutinin__InfluenzaA__ABU92729

SEQ ID NO: 93389 - RNA, 1701 nt, Artificial Sequence; identical to SEQ ID NO: 93265
  derived and/or modified sequence opt2 from hemagglutinin__InfluenzaA__ABU92730

SEQ ID NO: 93390 - RNA, 1701 nt, Artificial Sequence
  derived and/or modified sequence opt2 from hemagglutinin__InfluenzaA__ABU92731
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacgucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93391 - RNA, 1701 nt, Artificial Sequence
  derived and/or modified sequence opt2 from hemagglutinin__InfluenzaA__ABU92732
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93392 - RNA, 1701 nt, Artificial Sequence
  derived and/or modified sequence opt2 from hemagglutinin__InfluenzaA__ABU92733
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93393 - RNA, 1701 nt, Artificial Sequence; identical to SEQ ID NO: 93265
  derived and/or modified sequence opt2 from hemagglutinin__InfluenzaA__ABU92734

SEQ ID NO: 93394 - RNA, 1701 nt, Artificial Sequence
  derived and/or modified sequence opt2 from hemagglutinin__InfluenzaA__ABU92735
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcggcuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggcccccgcccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 93395 - RNA, 1701 nt, Artificial Sequence; identical to SEQ ID NO: 93340
  derived and/or modified sequence opt2 from hemagglutinin__InfluenzaA__ABU92737

SEQ ID NO: 93396 - RNA, 1701 nt, Artificial Sequence
  derived and/or modified sequence opt2 from hemagglutinin__InfluenzaA__ABU92738
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93397 - RNA, 1701 nt, Artificial Sequence; identical to SEQ ID NO: 93274
  derived and/or modified sequence opt2 from hemagglutinin__InfluenzaA__ABU92739

SEQ ID NO: 93398 - RNA, 1701 nt, Artificial Sequence
  derived and/or modified sequence opt2 from hemagglutinin__InfluenzaA__ABU92740
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacacccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93399 - RNA, 1701 nt, Artificial Sequence
  derived and/or modified sequence opt2 from hemagglutinin__InfluenzaA__ABU92741
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacaucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93400 - RNA, 1701 nt, Artificial Sequence; identical to SEQ ID NO: 93340
  derived and/or modified sequence opt2 from hemagglutinin__InfluenzaA__ABU92742

SEQ ID NO: 93401 - RNA, 1701 nt, Artificial Sequence
  derived and/or modified sequence opt2 from hemagglutinin__InfluenzaA__ABU92743
augaagaccaucaucgcccucuccuacauccucuaccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93402 - RNA, 1701 nt, Artificial Sequence; identical to SEQ ID NO: 93340
  derived and/or modified sequence opt2 from hemagglutinin__InfluenzaA__ABU92744

SEQ ID NO: 93403 - RNA, 1701 nt, Artificial Sequence
  derived and/or modified sequence opt2 from hemagglutinin__InfluenzaA__ABU92745
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcaucggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93404 - RNA, 1701 nt, Artificial Sequence; identical to SEQ ID NO: 93340
  derived and/or modified sequence opt2 from hemagglutinin__InfluenzaA__ABU92746

SEQ ID NO: 93405 - RNA, 1701 nt, Artificial Sequence; identical to SEQ ID NO: 91585
  derived and/or modified sequence opt2 from hemagglutinin__InfluenzaA__ABU92747

SEQ ID NO: 93406 - RNA, 1701 nt, Artificial Sequence
  derived and/or modified sequence opt2 from hemagglutinin__InfluenzaA__ABU92748
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccacuccaaguucaaguaccccgcccucaacgucaccaugcccaacaacgagaaguucgacaagcucuacaucuggggcguccaccaccccggcaccgacaacgaccagaccuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93407 - RNA, 1701 nt, Artificial Sequence; identical to SEQ ID NO: 91585
  derived and/or modified sequence opt2 from hemagglutinin__InfluenzaA__ABU92749

SEQ ID NO: 93408 - RNA, 1701 nt, Artificial Sequence
  derived and/or modified sequence opt2 from hemagglutinin__InfluenzaA__ABU92750
augaagaccaucaucgcccucuccuacauccucugccucgucuucgcccagaagcuccccggcaacgacaaccgcaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93409 - RNA, 1701 nt, Artificial Sequence
  derived and/or modified sequence opt2 from hemagglutinin__InfluenzaA__ABU92751
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93410 - RNA, 1701 nt, Artificial Sequence; identical to SEQ ID NO: 93274
  derived and/or modified sequence opt2 from hemagglutinin__InfluenzaA__ABU92752

SEQ ID NO: 93411 - RNA, 1701 nt, Artificial Sequence; identical to SEQ ID NO: 91585
  derived and/or modified sequence opt2 from hemagglutinin__InfluenzaA__ABU92753

SEQ ID NO: 93412 - RNA, 1701 nt, Artificial Sequence; identical to SEQ ID NO: 93274
  derived and/or modified sequence opt2 from hemagglutinin__InfluenzaA__ABU92754

SEQ ID NO: 93413 - RNA, 1701 nt, Artificial Sequence
  derived and/or modified sequence opt2 from hemagglutinin__InfluenzaA__ABU92755
augaagaccaucaucgcccucuccuacauccucugccucgucuucgcccagaagcuccccggcaacgacaacggcaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacgccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93414 - RNA, 1701 nt, Artificial Sequence
  derived and/or modified sequence opt2 from hemagglutinin__InfluenzaA__ABU92756
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93415 - RNA, 1701 nt, Artificial Sequence
  derived and/or modified sequence opt2 from hemagglutinin__InfluenzaA__ABU92757
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgccgcggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93416 - RNA, 1701 nt, Artificial Sequence; identical to SEQ ID NO: 93274
  derived and/or modified sequence opt2 from hemagglutinin__InfluenzaA__ABU92758

SEQ ID NO: 93417 - RNA, 1701 nt, Artificial Sequence; identical to SEQ ID NO: 93274
  derived and/or modified sequence opt2 from hemagglutinin__InfluenzaA__ABU92759

SEQ ID NO: 93418 - RNA, 1701 nt, Artificial Sequence
  derived and/or modified sequence opt2 from hemagglutinin__InfluenzaA__ABU92760
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93419 - RNA, 1698 nt, Artificial Sequence
  derived and/or modified sequence opt2 from hemagglutinin__InfluenzaA__ABV29579
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93420 - RNA, 1698 nt, Artificial Sequence
  derived and/or modified sequence opt2 from hemagglutinin__InfluenzaA__ABV29612
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgaggucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93421 - RNA, 1698 nt, Artificial Sequence
  derived and/or modified sequence opt2 from hemagglutinin__InfluenzaA__ABV29634
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgaggcccccucccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93422 - RNA, 1698 nt, Artificial Sequence
  derived and/or modified sequence opt2 from hemagglutinin__InfluenzaA__ABV29645
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93423 - RNA, 1698 nt, Artificial Sequence; identical to SEQ ID NO: 93422
  derived and/or modified sequence opt2 from hemagglutinin__InfluenzaA__ABV29667

SEQ ID NO: 93424 - RNA, 1698 nt, Artificial Sequence
  derived and/or modified sequence opt2 from hemagglutinin__InfluenzaA__ABV29678
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccgucgacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93425 - RNA, 1698 nt, Artificial Sequence
  derived and/or modified sequence opt2 from hemagglutinin__InfluenzaA__ABV29689
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaucggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93426 - RNA, 1698 nt, Artificial Sequence
  derived and/or modified sequence opt2 from hemagglutinin__InfluenzaA__ABV29700
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93427 - RNA, 1701 nt, Artificial Sequence
  derived and/or modified sequence opt2 from hemagglutinin__InfluenzaA__ABV29711
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93428 - RNA, 1701 nt, Artificial Sequence
  derived and/or modified sequence opt2 from hemagglutinin__InfluenzaA__ABV29722
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguuccucgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93429 - RNA, 1698 nt, Artificial Sequence
  derived and/or modified sequence opt2 from hemagglutinin__InfluenzaA__ABV29733
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93430 - RNA, 1698 nt, Artificial Sequence; identical to SEQ ID NO: 93422
  derived and/or modified sequence opt2 from hemagglutinin__InfluenzaA__ABV29744

SEQ ID NO: 93431 - RNA, 1698 nt, Artificial Sequence
  derived and/or modified sequence opt2 from hemagglutinin__InfluenzaA__ABV29755
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccucccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93432 - RNA, 1698 nt, Artificial Sequence; identical to SEQ ID NO: 93422
  derived and/or modified sequence opt2 from hemagglutinin__InfluenzaA__ABV29766

SEQ ID NO: 93433 - RNA, 1698 nt, Artificial Sequence
  derived and/or modified sequence opt2 from hemagglutinin__InfluenzaA__ABV29777
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93434 - RNA, 1698 nt, Artificial Sequence; identical to SEQ ID NO: 93422
  derived and/or modified sequence opt2 from hemagglutinin__InfluenzaA__ABV29788

SEQ ID NO: 93435 - RNA, 1698 nt, Artificial Sequence; identical to SEQ ID NO: 93426
  derived and/or modified sequence opt2 from hemagglutinin__InfluenzaA__ABV29799

SEQ ID NO: 93436 - RNA, 1701 nt, Artificial Sequence
  derived and/or modified sequence opt2 from hemagglutinin__InfluenzaA__ABV29821
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccaggucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 93437 - RNA, 1698 nt, Artificial Sequence; identical to SEQ ID NO: 93426
  derived and/or modified sequence opt2 from hemagglutinin__InfluenzaA__ABV29832

SEQ ID NO: 93438 - RNA, 1698 nt, Artificial Sequence; identical to SEQ ID NO: 93422
  derived and/or modified sequence opt2 from hemagglutinin__InfluenzaA__ABV29865

SEQ ID NO: 93439 - RNA, 1698 nt, Artificial Sequence; identical to SEQ ID NO: 93422
  derived and/or modified sequence opt2 from hemagglutinin__InfluenzaA__ABV29876

SEQ ID NO: 93440 - RNA, 1701 nt, Artificial Sequence
  derived and/or modified sequence opt2 from hemagglutinin__InfluenzaA__ABV29898
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93441 - RNA, 1701 nt, Artificial Sequence
  derived and/or modified sequence opt2 from hemagglutinin__InfluenzaA__ABV29909
augaagaccaucaucgcccucuccuacauccucugccucgucuucgcccagaagcuccccggcaacgacaacuccaccgccacccucugccucggccaccacgccguccccaacggcaccaucgucaagaccaucaccuccgaccagaucgaggucaccaacgccaccgagcucguccagaacuccuccaucggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93442 - RNA, 1698 nt, Artificial Sequence
  derived and/or modified sequence opt2 from hemagglutinin__InfluenzaA__ABV29920
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93443 - RNA, 1698 nt, Artificial Sequence; identical to SEQ ID NO: 93433
  derived and/or modified sequence opt2 from hemagglutinin__InfluenzaA__ABV29942

SEQ ID NO: 93444 - RNA, 1698 nt, Artificial Sequence; identical to SEQ ID NO: 93426
  derived and/or modified sequence opt2 from hemagglutinin__InfluenzaA__ABV29953

SEQ ID NO: 93445 - RNA, 1698 nt, Artificial Sequence; identical to SEQ ID NO: 93426
  derived and/or modified sequence opt2 from hemagglutinin__InfluenzaA__ABV29964

SEQ ID NO: 93446 - RNA, 1698 nt, Artificial Sequence; identical to SEQ ID NO: 93422
  derived and/or modified sequence opt2 from hemagglutinin__InfluenzaA__ABV29986

SEQ ID NO: 93447 - RNA, 1698 nt, Artificial Sequence; identical to SEQ ID NO: 93426
  derived and/or modified sequence opt2 from hemagglutinin__InfluenzaA__ABV29997

SEQ ID NO: 93448 - RNA, 1698 nt, Artificial Sequence; identical to SEQ ID NO: 93422
  derived and/or modified sequence opt2 from hemagglutinin__InfluenzaA__ABV30008

SEQ ID NO: 93449 - RNA, 1698 nt, Artificial Sequence; identical to SEQ ID NO: 93426
  derived and/or modified sequence opt2 from hemagglutinin__InfluenzaA__ABV30019

SEQ ID NO: 93450 - RNA, 1698 nt, Artificial Sequence; identical to SEQ ID NO: 93426
  derived and/or modified sequence opt2 from hemagglutinin__InfluenzaA__ABV30030

SEQ ID NO: 93451 - RNA, 1698 nt, Artificial Sequence
  derived and/or modified sequence opt2 from hemagglutinin__InfluenzaA__ABV30041
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaccgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucaucucccucggcgccaucuccuucuggaugugcuccaacggcucccuccagugccgcaucugcaucuga

SEQ ID NO: 93452 - RNA, 1701 nt, Artificial Sequence; identical to SEQ ID NO: 93440
  derived and/or modified sequence opt2 from hemagglutinin__InfluenzaA__ABV30063

SEQ ID NO: 93453 - RNA, 1701 nt, Artificial Sequence; identical to SEQ ID NO: 93440
  derived and/or modified sequence opt2 from hemagglutinin__InfluenzaA__ABV30074

SEQ ID NO: 93454 - RNA, 1698 nt, Artificial Sequence; identical to SEQ ID NO: 93426
  derived and/or modified sequence opt2 from hemagglutinin__InfluenzaA__ABV30085

SEQ ID NO: 93455 - RNA, 1698 nt, Artificial Sequence; identical to SEQ ID NO: 93426
  derived and/or modified sequence opt2 from hemagglutinin__InfluenzaA__ABV30096

SEQ ID NO: 93456 - RNA, 1698 nt, Artificial Sequence; identical to SEQ ID NO: 93422
  derived and/or modified sequence opt2 from hemagglutinin__InfluenzaA__ABV30107

SEQ ID NO: 93457 - RNA, 1698 nt, Artificial Sequence
  derived and/or modified sequence opt2 from hemagglutinin__InfluenzaA__ABV30129
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcaacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93458 - RNA, 1698 nt, Artificial Sequence
  derived and/or modified sequence opt2 from hemagglutinin__InfluenzaA__ABV30140
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccucaagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93459 - RNA, 1698 nt, Artificial Sequence
  derived and/or modified sequence opt2 from hemagglutinin__InfluenzaA__ABV30151
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacuccggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93460 - RNA, 1698 nt, Artificial Sequence
  derived and/or modified sequence opt2 from hemagglutinin__InfluenzaA__ABV30162
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93461 - RNA, 1698 nt, Artificial Sequence; identical to SEQ ID NO: 93426
  derived and/or modified sequence opt2 from hemagglutinin__InfluenzaA__ABV30173

SEQ ID NO: 93462 - RNA, 1698 nt, Artificial Sequence; identical to SEQ ID NO: 93426
  derived and/or modified sequence opt2 from hemagglutinin__InfluenzaA__ABV30184

SEQ ID NO: 93463 - RNA, 1701 nt, Artificial Sequence; identical to SEQ ID NO: 93440
  derived and/or modified sequence opt2 from hemagglutinin__InfluenzaA__ABV30217

SEQ ID NO: 93464 - RNA, 1701 nt, Artificial Sequence; identical to SEQ ID NO: 93440
  derived and/or modified sequence opt2 from hemagglutinin__InfluenzaA__ABV30228

SEQ ID NO: 93465 - RNA, 1701 nt, Artificial Sequence
  derived and/or modified sequence opt2 from hemagglutinin__InfluenzaA__ABV30261
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccaggucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaugggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgccgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93466 - RNA, 1701 nt, Artificial Sequence
  derived and/or modified sequence opt2 from hemagglutinin__InfluenzaA__ABV30272
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucuccaagcucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93467 - RNA, 1698 nt, Artificial Sequence
  derived and/or modified sequence opt2 from hemagglutinin__InfluenzaA__ABV30283
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcaacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93468 - RNA, 1698 nt, Artificial Sequence
  derived and/or modified sequence opt2 from hemagglutinin__InfluenzaA__ABV30294
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93469 - RNA, 1698 nt, Artificial Sequence
  derived and/or modified sequence opt2 from hemagglutinin__InfluenzaA__ABV30305
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcggcuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93470 - RNA, 1698 nt, Artificial Sequence; identical to SEQ ID NO: 93422
  derived and/or modified sequence opt2 from hemagglutinin__InfluenzaA__ABV30316

SEQ ID NO: 93471 - RNA, 1698 nt, Artificial Sequence; identical to SEQ ID NO: 93468
  derived and/or modified sequence opt2 from hemagglutinin__InfluenzaA__ABV30327

SEQ ID NO: 93472 - RNA, 1698 nt, Artificial Sequence; identical to SEQ ID NO: 93422
  derived and/or modified sequence opt2 from hemagglutinin__InfluenzaA__ABV30338

SEQ ID NO: 93473 - RNA, 1698 nt, Artificial Sequence; identical to SEQ ID NO: 93426
  derived and/or modified sequence opt2 from hemagglutinin__InfluenzaA__ABV30349

SEQ ID NO: 93474 - RNA, 1698 nt, Artificial Sequence
  derived and/or modified sequence opt2 from hemagglutinin__InfluenzaA__ABV30360
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcaacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcaucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93475 - RNA, 1698 nt, Artificial Sequence; identical to SEQ ID NO: 93426
  derived and/or modified sequence opt2 from hemagglutinin__InfluenzaA__ABV30371

SEQ ID NO: 93476 - RNA, 1701 nt, Artificial Sequence; identical to SEQ ID NO: 93241
  derived and/or modified sequence opt2 from hemagglutinin__InfluenzaA__ABV30382

SEQ ID NO: 93477 - RNA, 1701 nt, Artificial Sequence; identical to SEQ ID NO: 92142
  derived and/or modified sequence opt2 from hemagglutinin__InfluenzaA__ABV30393

SEQ ID NO: 93478 - RNA, 1701 nt, Artificial Sequence
  derived and/or modified sequence opt2 from hemagglutinin__InfluenzaA__ABV30404
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaagugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaccuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93479 - RNA, 1701 nt, Artificial Sequence
  derived and/or modified sequence opt2 from hemagglutinin__InfluenzaA__ABV30415
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93480 - RNA, 1701 nt, Artificial Sequence; identical to SEQ ID NO: 93440
  derived and/or modified sequence opt2 from hemagglutinin__InfluenzaA__ABV30426

SEQ ID NO: 93481 - RNA, 1701 nt, Artificial Sequence
  derived and/or modified sequence opt2 from hemagglutinin__InfluenzaA__ABV30437
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaaccacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93482 - RNA, 1701 nt, Artificial Sequence; identical to SEQ ID NO: 93440
  derived and/or modified sequence opt2 from hemagglutinin__InfluenzaA__ABV30448

SEQ ID NO: 93483 - RNA, 1698 nt, Artificial Sequence
  derived and/or modified sequence opt2 from hemagglutinin__InfluenzaA__ABV30459
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgaggcccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93484 - RNA, 1701 nt, Artificial Sequence; identical to SEQ ID NO: 93440
  derived and/or modified sequence opt2 from hemagglutinin__InfluenzaA__ABV30470

SEQ ID NO: 93485 - RNA, 1698 nt, Artificial Sequence; identical to SEQ ID NO: 93422
  derived and/or modified sequence opt2 from hemagglutinin__InfluenzaA__ABV30492

SEQ ID NO: 93486 - RNA, 1698 nt, Artificial Sequence
  derived and/or modified sequence opt2 from hemagglutinin__InfluenzaA__ABV30503
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccaucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93487 - RNA, 1701 nt, Artificial Sequence; identical to SEQ ID NO: 93440
  derived and/or modified sequence opt2 from hemagglutinin__InfluenzaA__ABV30514

SEQ ID NO: 93488 - RNA, 1698 nt, Artificial Sequence
  derived and/or modified sequence opt2 from hemagglutinin__InfluenzaA__ABV30525
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacuccggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacacccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93489 - RNA, 1698 nt, Artificial Sequence; identical to SEQ ID NO: 93426
  derived and/or modified sequence opt2 from hemagglutinin__InfluenzaA__ABV30536

SEQ ID NO: 93490 - RNA, 1698 nt, Artificial Sequence; identical to SEQ ID NO: 93433
  derived and/or modified sequence opt2 from hemagglutinin__InfluenzaA__ABV30547

SEQ ID NO: 93491 - RNA, 1698 nt, Artificial Sequence; identical to SEQ ID NO: 93426
  derived and/or modified sequence opt2 from hemagglutinin__InfluenzaA__ABV30558

SEQ ID NO: 93492 - RNA, 1698 nt, Artificial Sequence
  derived and/or modified sequence opt2 from hemagglutinin__InfluenzaA__ABV30569
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93493 - RNA, 1698 nt, Artificial Sequence; identical to SEQ ID NO: 93426
  derived and/or modified sequence opt2 from hemagglutinin__InfluenzaA__ABV30580

SEQ ID NO: 93494 - RNA, 1698 nt, Artificial Sequence; identical to SEQ ID NO: 93422
  derived and/or modified sequence opt2 from hemagglutinin__InfluenzaA__ABV30591

SEQ ID NO: 93495 - RNA, 1698 nt, Artificial Sequence; identical to SEQ ID NO: 93422
  derived and/or modified sequence opt2 from hemagglutinin__InfluenzaA__ABV30602

SEQ ID NO: 93496 - RNA, 1698 nt, Artificial Sequence
  derived and/or modified sequence opt2 from hemagglutinin__InfluenzaA__ABV30613
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcaugaagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93497 - RNA, 1698 nt, Artificial Sequence; identical to SEQ ID NO: 93422
  derived and/or modified sequence opt2 from hemagglutinin__InfluenzaA__ABV30624

SEQ ID NO: 93498 - RNA, 1701 nt, Artificial Sequence
  derived and/or modified sequence opt2 from hemagglutinin__InfluenzaA__ABV30646
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccuacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93499 - RNA, 1701 nt, Artificial Sequence
  derived and/or modified sequence opt2 from hemagglutinin__InfluenzaA__ABV30657
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccaggucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93500 - RNA, 1701 nt, Artificial Sequence; identical to SEQ ID NO: 93499
  derived and/or modified sequence opt2 from hemagglutinin__InfluenzaA__ABV45860

SEQ ID NO: 93501 - RNA, 1698 nt, Artificial Sequence; identical to SEQ ID NO: 93467
  derived and/or modified sequence opt2 from hemagglutinin__InfluenzaA__ABV45871

SEQ ID NO: 93502 - RNA, 1698 nt, Artificial Sequence; identical to SEQ ID NO: 93426
  derived and/or modified sequence opt2 from hemagglutinin__InfluenzaA__ABV45882

SEQ ID NO: 93503 - RNA, 1698 nt, Artificial Sequence; identical to SEQ ID NO: 93433
  derived and/or modified sequence opt2 from hemagglutinin__InfluenzaA__ABV45893

SEQ ID NO: 93504 - RNA, 1701 nt, Artificial Sequence; identical to SEQ ID NO: 93241
  derived and/or modified sequence opt2 from hemagglutinin__InfluenzaA__ABV45904

SEQ ID NO: 93505 - RNA, 1698 nt, Artificial Sequence; identical to SEQ ID NO: 93433
  derived and/or modified sequence opt2 from hemagglutinin__InfluenzaA__ABV45926

SEQ ID NO: 93506 - RNA, 1698 nt, Artificial Sequence
  derived and/or modified sequence opt2 from hemagglutinin__InfluenzaA__ABV45937
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgagaccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93507 - RNA, 1698 nt, Artificial Sequence; identical to SEQ ID NO: 93459
  derived and/or modified sequence opt2 from hemagglutinin__InfluenzaA__ABV45948

SEQ ID NO: 93508 - RNA, 1698 nt, Artificial Sequence; identical to SEQ ID NO: 93426
  derived and/or modified sequence opt2 from hemagglutinin__InfluenzaA__ABV45959

SEQ ID NO: 93509 - RNA, 1701 nt, Artificial Sequence
  derived and/or modified sequence opt2 from hemagglutinin__InfluenzaA__ABV45970
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93510 - RNA, 1701 nt, Artificial Sequence
  derived and/or modified sequence opt2 from hemagglutinin__InfluenzaA__ABV45981
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggaucaucuggaucuccuucgccaucuccugcuuccuccucugcgucgcccuccucggcuucaucaugugggccugccagaagggcaacauccgcugcaacaucugcaucuga

SEQ ID NO: 93511 - RNA, 1698 nt, Artificial Sequence
  derived and/or modified sequence opt2 from hemagglutinin__InfluenzaA__ABV82551
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93512 - RNA, 1701 nt, Artificial Sequence; identical to SEQ ID NO: 93440
  derived and/or modified sequence opt2 from hemagglutinin__InfluenzaA__ABV82562

SEQ ID NO: 93513 - RNA, 1701 nt, Artificial Sequence; identical to SEQ ID NO: 93440
  derived and/or modified sequence opt2 from hemagglutinin__InfluenzaA__ABW36168

SEQ ID NO: 93514 - RNA, 1698 nt, Artificial Sequence; identical to SEQ ID NO: 93426
  derived and/or modified sequence opt2 from hemagglutinin__InfluenzaA__ABW36179

SEQ ID NO: 93515 - RNA, 1698 nt, Artificial Sequence; identical to SEQ ID NO: 93469
  derived and/or modified sequence opt2 from hemagglutinin__InfluenzaA__ABW36190

SEQ ID NO: 93516 - RNA, 1698 nt, Artificial Sequence; identical to SEQ ID NO: 93426
  derived and/or modified sequence opt2 from hemagglutinin__InfluenzaA__ABW36201

SEQ ID NO: 93517 - RNA, 1698 nt, Artificial Sequence
  derived and/or modified sequence opt2 from hemagglutinin__InfluenzaA__ABW36212
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggagaacuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggccucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagggccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93518 - RNA, 1698 nt, Artificial Sequence; identical to SEQ ID NO: 93422
  derived and/or modified sequence opt2 from hemagglutinin__InfluenzaA__ABW36223

SEQ ID NO: 93519 - RNA, 1698 nt, Artificial Sequence; identical to SEQ ID NO: 93422
  derived and/or modified sequence opt2 from hemagglutinin__InfluenzaA__ABW36245

SEQ ID NO: 93520 - RNA, 1698 nt, Artificial Sequence; identical to SEQ ID NO: 93422
  derived and/or modified sequence opt2 from hemagglutinin__InfluenzaA__ABW36267

SEQ ID NO: 93521 - RNA, 1698 nt, Artificial Sequence; identical to SEQ ID NO: 93426
  derived and/or modified sequence opt2 from hemagglutinin__InfluenzaA__ABW36278

SEQ ID NO: 93522 - RNA, 1698 nt, Artificial Sequence
  derived and/or modified sequence opt2 from hemagglutinin__InfluenzaA__ABW36289
augaagcucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93523 - RNA, 1698 nt, Artificial Sequence; identical to SEQ ID NO: 93433
  derived and/or modified sequence opt2 from hemagglutinin__InfluenzaA__ABW36300

SEQ ID NO: 93524 - RNA, 1701 nt, Artificial Sequence
  derived and/or modified sequence opt2 from hemagglutinin__InfluenzaA__ABW36311
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacucccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93525 - RNA, 1701 nt, Artificial Sequence
  derived and/or modified sequence opt2 from hemagglutinin__InfluenzaA__ABW38363
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcucaucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93526 - RNA, 1698 nt, Artificial Sequence
  derived and/or modified sequence opt2 from hemagglutinin__InfluenzaA__ABW39777
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggagaacuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggccucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93527 - RNA, 1698 nt, Artificial Sequence; identical to SEQ ID NO: 93426
  derived and/or modified sequence opt2 from hemagglutinin__InfluenzaA__ABW39806

SEQ ID NO: 93528 - RNA, 1698 nt, Artificial Sequence; identical to SEQ ID NO: 93433
  derived and/or modified sequence opt2 from hemagglutinin__InfluenzaA__ABW39817

SEQ ID NO: 93529 - RNA, 1698 nt, Artificial Sequence
  derived and/or modified sequence opt2 from hemagglutinin__InfluenzaA__ABW39828
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93530 - RNA, 1698 nt, Artificial Sequence
  derived and/or modified sequence opt2 from hemagglutinin__InfluenzaA__ABW39839
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacuccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93531 - RNA, 1698 nt, Artificial Sequence
  derived and/or modified sequence opt2 from hemagglutinin__InfluenzaA__ABW39850
augaaggucaagcuccucguccuccucugcaccuucaccgccaccaacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagggccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93532 - RNA, 1698 nt, Artificial Sequence; identical to SEQ ID NO: 93457
  derived and/or modified sequence opt2 from hemagglutinin__InfluenzaA__ABW39861

SEQ ID NO: 93533 - RNA, 1701 nt, Artificial Sequence; identical to SEQ ID NO: 93440
  derived and/or modified sequence opt2 from hemagglutinin__InfluenzaA__ABW39872

SEQ ID NO: 93534 - RNA, 1698 nt, Artificial Sequence
  derived and/or modified sequence opt2 from hemagglutinin__InfluenzaA__ABW39883
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccacaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93535 - RNA, 1698 nt, Artificial Sequence; identical to SEQ ID NO: 93467
  derived and/or modified sequence opt2 from hemagglutinin__InfluenzaA__ABW39894

SEQ ID NO: 93536 - RNA, 1698 nt, Artificial Sequence; identical to SEQ ID NO: 93422
  derived and/or modified sequence opt2 from hemagglutinin__InfluenzaA__ABW39905

SEQ ID NO: 93537 - RNA, 1698 nt, Artificial Sequence; identical to SEQ ID NO: 93426
  derived and/or modified sequence opt2 from hemagglutinin__InfluenzaA__ABW39927

SEQ ID NO: 93538 - RNA, 1701 nt, Artificial Sequence
  derived and/or modified sequence opt2 from hemagglutinin__InfluenzaA__ABW39938
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgccuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93539 - RNA, 1698 nt, Artificial Sequence; identical to SEQ ID NO: 93426
  derived and/or modified sequence opt2 from hemagglutinin__InfluenzaA__ABW39949

SEQ ID NO: 93540 - RNA, 1698 nt, Artificial Sequence; identical to SEQ ID NO: 93467
  derived and/or modified sequence opt2 from hemagglutinin__InfluenzaA__ABW39960

SEQ ID NO: 93541 - RNA, 1698 nt, Artificial Sequence; identical to SEQ ID NO: 93422
  derived and/or modified sequence opt2 from hemagglutinin__InfluenzaA__ABW39982

SEQ ID NO: 93542 - RNA, 1698 nt, Artificial Sequence; identical to SEQ ID NO: 93442
  derived and/or modified sequence opt2 from hemagglutinin__InfluenzaA__ABW39993

SEQ ID NO: 93543 - RNA, 1698 nt, Artificial Sequence; identical to SEQ ID NO: 93422
  derived and/or modified sequence opt2 from hemagglutinin__InfluenzaA__ABW40004

SEQ ID NO: 93544 - RNA, 1698 nt, Artificial Sequence; identical to SEQ ID NO: 93468
  derived and/or modified sequence opt2 from hemagglutinin__InfluenzaA__ABW40015

SEQ ID NO: 93545 - RNA, 1701 nt, Artificial Sequence; identical to SEQ ID NO: 93499
  derived and/or modified sequence opt2 from hemagglutinin__InfluenzaA__ABW40026

SEQ ID NO: 93546 - RNA, 1698 nt, Artificial Sequence; identical to SEQ ID NO: 93422
  derived and/or modified sequence opt2 from hemagglutinin__InfluenzaA__ABW40037

SEQ ID NO: 93547 - RNA, 1698 nt, Artificial Sequence
  derived and/or modified sequence opt2 from hemagglutinin__InfluenzaA__ABW40048
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagaagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93548 - RNA, 1698 nt, Artificial Sequence; identical to SEQ ID NO: 93426
  derived and/or modified sequence opt2 from hemagglutinin__InfluenzaA__ABW40059

SEQ ID NO: 93549 - RNA, 1698 nt, Artificial Sequence
  derived and/or modified sequence opt2 from hemagglutinin__InfluenzaA__ABW40070
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacuccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93550 - RNA, 1701 nt, Artificial Sequence; identical to SEQ ID NO: 93440
  derived and/or modified sequence opt2 from hemagglutinin__InfluenzaA__ABW40081

SEQ ID NO: 93551 - RNA, 1698 nt, Artificial Sequence
  derived and/or modified sequence opt2 from hemagglutinin__InfluenzaA__ABW40092
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93552 - RNA, 1698 nt, Artificial Sequence; identical to SEQ ID NO: 93469
  derived and/or modified sequence opt2 from hemagglutinin__InfluenzaA__ABW40103

SEQ ID NO: 93553 - RNA, 1698 nt, Artificial Sequence
  derived and/or modified sequence opt2 from hemagglutinin__InfluenzaA__ABW40114
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccaccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93554 - RNA, 1698 nt, Artificial Sequence; identical to SEQ ID NO: 93422
  derived and/or modified sequence opt2 from hemagglutinin__InfluenzaA__ABW40125

SEQ ID NO: 93555 - RNA, 1701 nt, Artificial Sequence; identical to SEQ ID NO: 93440
  derived and/or modified sequence opt2 from hemagglutinin__InfluenzaA__ABW40136

SEQ ID NO: 93556 - RNA, 1698 nt, Artificial Sequence; identical to SEQ ID NO: 93457
  derived and/or modified sequence opt2 from hemagglutinin__InfluenzaA__ABW40147

SEQ ID NO: 93557 - RNA, 1698 nt, Artificial Sequence; identical to SEQ ID NO: 93426
  derived and/or modified sequence opt2 from hemagglutinin__InfluenzaA__ABW40158

SEQ ID NO: 93558 - RNA, 1698 nt, Artificial Sequence; identical to SEQ ID NO: 93426
  derived and/or modified sequence opt2 from hemagglutinin__InfluenzaA__ABW40180

SEQ ID NO: 93559 - RNA, 1701 nt, Artificial Sequence; identical to SEQ ID NO: 93440
  derived and/or modified sequence opt2 from hemagglutinin__InfluenzaA__ABW40191

SEQ ID NO: 93560 - RNA, 1698 nt, Artificial Sequence; identical to SEQ ID NO: 93442
  derived and/or modified sequence opt2 from hemagglutinin__InfluenzaA__ABW40202

SEQ ID NO: 93561 - RNA, 1698 nt, Artificial Sequence; identical to SEQ ID NO: 93422
  derived and/or modified sequence opt2 from hemagglutinin__InfluenzaA__ABW40213

SEQ ID NO: 93562 - RNA, 1698 nt, Artificial Sequence; identical to SEQ ID NO: 93422
  derived and/or modified sequence opt2 from hemagglutinin__InfluenzaA__ABW40224

SEQ ID NO: 93563 - RNA, 1698 nt, Artificial Sequence; identical to SEQ ID NO: 93426
  derived and/or modified sequence opt2 from hemagglutinin__InfluenzaA__ABW40235

SEQ ID NO: 93564 - RNA, 1701 nt, Artificial Sequence
  derived and/or modified sequence opt2 from hemagglutinin__InfluenzaA__ABW40246
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccaggucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93565 - RNA, 1698 nt, Artificial Sequence
  derived and/or modified sequence opt2 from hemagglutinin__InfluenzaA__ABW40257
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93566 - RNA, 1701 nt, Artificial Sequence; identical to SEQ ID NO: 93499
  derived and/or modified sequence opt2 from hemagglutinin__InfluenzaA__ABW40268

SEQ ID NO: 93567 - RNA, 1698 nt, Artificial Sequence
  derived and/or modified sequence opt2 from hemagglutinin__InfluenzaA__ABW40312
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggccgcuccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93568 - RNA, 1701 nt, Artificial Sequence; identical to SEQ ID NO: 93440
  derived and/or modified sequence opt2 from hemagglutinin__InfluenzaA__ABW40323

SEQ ID NO: 93569 - RNA, 1698 nt, Artificial Sequence; identical to SEQ ID NO: 93468
  derived and/or modified sequence opt2 from hemagglutinin__InfluenzaA__ABW40334

SEQ ID NO: 93570 - RNA, 1698 nt, Artificial Sequence; identical to SEQ ID NO: 93468
  derived and/or modified sequence opt2 from hemagglutinin__InfluenzaA__ABW40345

SEQ ID NO: 93571 - RNA, 1698 nt, Artificial Sequence
  derived and/or modified sequence opt2 from hemagglutinin__InfluenzaA__ABW40356
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucgucauguggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93572 - RNA, 1698 nt, Artificial Sequence; identical to SEQ ID NO: 93426
  derived and/or modified sequence opt2 from hemagglutinin__InfluenzaA__ABW40367

SEQ ID NO: 93573 - RNA, 1701 nt, Artificial Sequence; identical to SEQ ID NO: 93440
  derived and/or modified sequence opt2 from hemagglutinin__InfluenzaA__ABW40378

SEQ ID NO: 93574 - RNA, 1698 nt, Artificial Sequence; identical to SEQ ID NO: 93426
  derived and/or modified sequence opt2 from hemagglutinin__InfluenzaA__ABW40389

SEQ ID NO: 93575 - RNA, 1698 nt, Artificial Sequence; identical to SEQ ID NO: 93422
  derived and/or modified sequence opt2 from hemagglutinin__InfluenzaA__ABW40400

SEQ ID NO: 93576 - RNA, 1698 nt, Artificial Sequence; identical to SEQ ID NO: 93422
  derived and/or modified sequence opt2 from hemagglutinin__InfluenzaA__ABW40411

SEQ ID NO: 93577 - RNA, 1698 nt, Artificial Sequence; identical to SEQ ID NO: 93422
  derived and/or modified sequence opt2 from hemagglutinin__InfluenzaA__ABW40422

SEQ ID NO: 93578 - RNA, 1698 nt, Artificial Sequence; identical to SEQ ID NO: 93468
  derived and/or modified sequence opt2 from hemagglutinin__InfluenzaA__ABW40433

SEQ ID NO: 93579 - RNA, 1698 nt, Artificial Sequence; identical to SEQ ID NO: 93442
  derived and/or modified sequence opt2 from hemagglutinin__InfluenzaA__ABW40444

SEQ ID NO: 93580 - RNA, 1698 nt, Artificial Sequence; identical to SEQ ID NO: 93459
  derived and/or modified sequence opt2 from hemagglutinin__InfluenzaA__ABW40455

SEQ ID NO: 93581 - RNA, 1698 nt, Artificial Sequence; identical to SEQ ID NO: 93426
  derived and/or modified sequence opt2 from hemagglutinin__InfluenzaA__ABW40466

SEQ ID NO: 93582 - RNA, 1698 nt, Artificial Sequence; identical to SEQ ID NO: 93426
  derived and/or modified sequence opt2 from hemagglutinin__InfluenzaA__ABW40477

SEQ ID NO: 93583 - RNA, 1698 nt, Artificial Sequence; identical to SEQ ID NO: 93422
  derived and/or modified sequence opt2 from hemagglutinin__InfluenzaA__ABW40488

SEQ ID NO: 93584 - RNA, 1698 nt, Artificial Sequence; identical to SEQ ID NO: 93426
  derived and/or modified sequence opt2 from hemagglutinin__InfluenzaA__ABW40499

SEQ ID NO: 93585 - RNA, 1698 nt, Artificial Sequence; identical to SEQ ID NO: 93468
  derived and/or modified sequence opt2 from hemagglutinin__InfluenzaA__ABW40510

SEQ ID NO: 93586 - RNA, 1698 nt, Artificial Sequence; identical to SEQ ID NO: 93422
  derived and/or modified sequence opt2 from hemagglutinin__InfluenzaA__ABW40521

SEQ ID NO: 93587 - RNA, 1698 nt, Artificial Sequence; identical to SEQ ID NO: 93426
  derived and/or modified sequence opt2 from hemagglutinin__InfluenzaA__ABW40532

SEQ ID NO: 93588 - RNA, 1698 nt, Artificial Sequence
  derived and/or modified sequence opt2 from hemagglutinin__InfluenzaA__ABW40543
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaccuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93589 - RNA, 1698 nt, Artificial Sequence; identical to SEQ ID NO: 93567
  derived and/or modified sequence opt2 from hemagglutinin__InfluenzaA__ABW40554

SEQ ID NO: 93590 - RNA, 1698 nt, Artificial Sequence; identical to SEQ ID NO: 93426
  derived and/or modified sequence opt2 from hemagglutinin__InfluenzaA__ABW40565

SEQ ID NO: 93591 - RNA, 1698 nt, Artificial Sequence
  derived and/or modified sequence opt2 from hemagglutinin__InfluenzaA__ABW40576
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacaccuacgucuccgucgucuccucccacuacucccgccgcuucacccccgagaucgccaagcgccccaagguccgcgaccaggagggccgcaucaacuacuacuggacccuccucgagcccggcgacaccaucauccucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93592 - RNA, 1701 nt, Artificial Sequence; identical to SEQ ID NO: 93499
  derived and/or modified sequence opt2 from hemagglutinin__InfluenzaA__ABW40587

SEQ ID NO: 93593 - RNA, 1698 nt, Artificial Sequence; identical to SEQ ID NO: 93468
  derived and/or modified sequence opt2 from hemagglutinin__InfluenzaA__ABW40598

SEQ ID NO: 93594 - RNA, 1698 nt, Artificial Sequence; identical to SEQ ID NO: 93442
  derived and/or modified sequence opt2 from hemagglutinin__InfluenzaA__ABW40609

SEQ ID NO: 93595 - RNA, 1698 nt, Artificial Sequence; identical to SEQ ID NO: 93457
  derived and/or modified sequence opt2 from hemagglutinin__InfluenzaA__ABW40620

SEQ ID NO: 93596 - RNA, 1701 nt, Artificial Sequence; identical to SEQ ID NO: 93499
  derived and/or modified sequence opt2 from hemagglutinin__InfluenzaA__ABW40631

SEQ ID NO: 93597 - RNA, 1698 nt, Artificial Sequence; identical to SEQ ID NO: 93422
  derived and/or modified sequence opt2 from hemagglutinin__InfluenzaA__ABW40642

SEQ ID NO: 93598 - RNA, 1701 nt, Artificial Sequence; identical to SEQ ID NO: 93499
  derived and/or modified sequence opt2 from hemagglutinin__InfluenzaA__ABW40653

SEQ ID NO: 93599 - RNA, 1698 nt, Artificial Sequence; identical to SEQ ID NO: 93468
  derived and/or modified sequence opt2 from hemagglutinin__InfluenzaA__ABW40664

SEQ ID NO: 93600 - RNA, 1698 nt, Artificial Sequence; identical to SEQ ID NO: 93442
  derived and/or modified sequence opt2 from hemagglutinin__InfluenzaA__ABW40675

SEQ ID NO: 93601 - RNA, 1698 nt, Artificial Sequence; identical to SEQ ID NO: 93571
  derived and/or modified sequence opt2 from hemagglutinin__InfluenzaA__ABW71294

SEQ ID NO: 93602 - RNA, 1698 nt, Artificial Sequence; identical to SEQ ID NO: 93468
  derived and/or modified sequence opt2 from hemagglutinin__InfluenzaA__ABW71305

SEQ ID NO: 93603 - RNA, 1698 nt, Artificial Sequence
  derived and/or modified sequence opt2 from hemagglutinin__InfluenzaA__ABW71316
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagccccgcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93604 - RNA, 1698 nt, Artificial Sequence; identical to SEQ ID NO: 93422
  derived and/or modified sequence opt2 from hemagglutinin__InfluenzaA__ABW71327

SEQ ID NO: 93605 - RNA, 1698 nt, Artificial Sequence; identical to SEQ ID NO: 93426
  derived and/or modified sequence opt2 from hemagglutinin__InfluenzaA__ABW71338

SEQ ID NO: 93606 - RNA, 1701 nt, Artificial Sequence; identical to SEQ ID NO: 93440
  derived and/or modified sequence opt2 from hemagglutinin__InfluenzaA__ABW71349

SEQ ID NO: 93607 - RNA, 1698 nt, Artificial Sequence
  derived and/or modified sequence opt2 from hemagglutinin__InfluenzaA__ABW71360
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93608 - RNA, 1698 nt, Artificial Sequence; identical to SEQ ID NO: 93442
  derived and/or modified sequence opt2 from hemagglutinin__InfluenzaA__ABW71371

SEQ ID NO: 93609 - RNA, 1698 nt, Artificial Sequence
  derived and/or modified sequence opt2 from hemagglutinin__InfluenzaA__ABW71382
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccugguccaaccacaccaucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93610 - RNA, 1698 nt, Artificial Sequence
  derived and/or modified sequence opt2 from hemagglutinin__InfluenzaA__ABW71393
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93611 - RNA, 1698 nt, Artificial Sequence; identical to SEQ ID NO: 93571
  derived and/or modified sequence opt2 from hemagglutinin__InfluenzaA__ABW71404

SEQ ID NO: 93612 - RNA, 1698 nt, Artificial Sequence; identical to SEQ ID NO: 93459
  derived and/or modified sequence opt2 from hemagglutinin__InfluenzaA__ABW71415

SEQ ID NO: 93613 - RNA, 1698 nt, Artificial Sequence
  derived and/or modified sequence opt2 from hemagglutinin__InfluenzaA__ABW71426
augaaggccaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93614 - RNA, 1698 nt, Artificial Sequence
  derived and/or modified sequence opt2 from hemagglutinin__InfluenzaA__ABW71448
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccaucgccuccucccucguccuccucgucucccucggcgccaucuccuucuggaugugcuccaacggcucccuccagugccgcaucugcaucuga

SEQ ID NO: 93615 - RNA, 1698 nt, Artificial Sequence; identical to SEQ ID NO: 93442
  derived and/or modified sequence opt2 from hemagglutinin__InfluenzaA__ABW71459

SEQ ID NO: 93616 - RNA, 1698 nt, Artificial Sequence; identical to SEQ ID NO: 93426
  derived and/or modified sequence opt2 from hemagglutinin__InfluenzaA__ABW71470

SEQ ID NO: 93617 - RNA, 1707 nt, Artificial Sequence
  derived and/or modified sequence opt2 from hemagglutinin__InfluenzaA__ABW74702
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcuccuccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcaucgaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcaucuga

SEQ ID NO: 93618 - RNA, 1707 nt, Artificial Sequence
  derived and/or modified sequence opt2 from hemagglutinin__InfluenzaA__ABW74703
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucaaggacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccgucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacucccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93619 - RNA, 1707 nt, Artificial Sequence
  derived and/or modified sequence opt2 from hemagglutinin__InfluenzaA__ABW74705
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93620 - RNA, 1707 nt, Artificial Sequence
  derived and/or modified sequence opt2 from hemagglutinin__InfluenzaA__ABW74707
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagauggccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93621 - RNA, 1707 nt, Artificial Sequence
  derived and/or modified sequence opt2 from hemagglutinin__InfluenzaA__ABW74708
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgcuccguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcaucuga

SEQ ID NO: 93622 - RNA, 1707 nt, Artificial Sequence; identical to SEQ ID NO: 93619
  derived and/or modified sequence opt2 from hemagglutinin__InfluenzaA__ABW74710

SEQ ID NO: 93623 - RNA, 1707 nt, Artificial Sequence; identical to SEQ ID NO: 93619
  derived and/or modified sequence opt2 from hemagglutinin__InfluenzaA__ABW74711

SEQ ID NO: 93624 - RNA, 1707 nt, Artificial Sequence
  derived and/or modified sequence opt2 from hemagglutinin__InfluenzaA__ABW74712
auggagaagaucguccuccuccucuccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacaacgaggaggagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacuccaacugcaacaccaagugccagacccccaugggcgccaucaacuccuccaugcccuuccacaacauccacccccucaccaucggcgagugccccaaguacgucaaguccucccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93625 - RNA, 1701 nt, Artificial Sequence
  derived and/or modified sequence opt2 from hemagglutinin__InfluenzaA__ABW80976
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucuccaucuacgcccaggccuccggccgcgucaccgucuccaccaagcgcucccagcagaccgucauccccaacaucggcucccgccccuggguccgcggcgucuccuccggcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93626 - RNA, 1701 nt, Artificial Sequence
  derived and/or modified sequence opt2 from hemagglutinin__InfluenzaA__ABW80977
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucaaccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucuccuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93627 - RNA, 1698 nt, Artificial Sequence
  derived and/or modified sequence opt2 from hemagglutinin__InfluenzaA__ABW80979
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93628 - RNA, 1701 nt, Artificial Sequence
  derived and/or modified sequence opt2 from hemagglutinin__InfluenzaA__ABW81505
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93629 - RNA, 1698 nt, Artificial Sequence
  derived and/or modified sequence opt2 from hemagglutinin__InfluenzaA__ABW81506
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 93630 - RNA, 1701 nt, Artificial Sequence
  derived and/or modified sequence opt2 from hemagglutinin__InfluenzaA__ABW81507
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgucccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93631 - RNA, 1698 nt, Artificial Sequence
  derived and/or modified sequence opt2 from hemagglutinin__InfluenzaA__ABW81508
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucacccgcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93632 - RNA, 1701 nt, Artificial Sequence; identical to SEQ ID NO: 93628
  derived and/or modified sequence opt2 from hemagglutinin__InfluenzaA__ABW81509

SEQ ID NO: 93633 - RNA, 1698 nt, Artificial Sequence
  derived and/or modified sequence opt2 from hemagglutinin__InfluenzaA__ABW81511
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacuccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93634 - RNA, 1698 nt, Artificial Sequence; identical to SEQ ID NO: 91808
  derived and/or modified sequence opt2 from hemagglutinin__InfluenzaA__ABW81512

SEQ ID NO: 93635 - RNA, 1698 nt, Artificial Sequence; identical to SEQ ID NO: 92897
  derived and/or modified sequence opt2 from hemagglutinin__InfluenzaA__ABW81513

SEQ ID NO: 93636 - RNA, 1698 nt, Artificial Sequence
  derived and/or modified sequence opt2 from hemagglutinin__InfluenzaA__ABW81514
augaaggucaagcuccucguccuccucugcaccuucaccgccaccuacgccgacaccaucugcaucuccuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93637 - RNA, 1698 nt, Artificial Sequence; identical to SEQ ID NO: 92897
  derived and/or modified sequence opt2 from hemagglutinin__InfluenzaA__ABW81515

SEQ ID NO: 93638 - RNA, 1698 nt, Artificial Sequence; identical to SEQ ID NO: 92897
  derived and/or modified sequence opt2 from hemagglutinin__InfluenzaA__ABW81516

SEQ ID NO: 93639 - RNA, 1698 nt, Artificial Sequence
  derived and/or modified sequence opt2 from hemagglutinin__InfluenzaA__ABW81517
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccaucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93640 - RNA, 1698 nt, Artificial Sequence
  derived and/or modified sequence opt2 from hemagglutinin__InfluenzaA__ABW81518
augaaggucaagcuccucguccuccucugcaccuacaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93641 - RNA, 1698 nt, Artificial Sequence
  derived and/or modified sequence opt2 from hemagglutinin__InfluenzaA__ABW81519
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgcccacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93642 - RNA, 1698 nt, Artificial Sequence
  derived and/or modified sequence opt2 from hemagglutinin__InfluenzaA__ABW81520
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93643 - RNA, 1698 nt, Artificial Sequence
  derived and/or modified sequence opt2 from hemagglutinin__InfluenzaA__ABW81521
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucuccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93644 - RNA, 1698 nt, Artificial Sequence; identical to SEQ ID NO: 92897
  derived and/or modified sequence opt2 from hemagglutinin__InfluenzaA__ABW81522

SEQ ID NO: 93645 - RNA, 1698 nt, Artificial Sequence; identical to SEQ ID NO: 92897
  derived and/or modified sequence opt2 from hemagglutinin__InfluenzaA__ABW81523

SEQ ID NO: 93646 - RNA, 1698 nt, Artificial Sequence
  derived and/or modified sequence opt2 from hemagglutinin__InfluenzaA__ABW81524
augaaggucaagcuccucguccuccucugcaccuucaccgccaccuacgccgacaccaucugcaucggcuaccacgccaacaacuccaccgacaccaucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93647 - RNA, 1698 nt, Artificial Sequence
  derived and/or modified sequence opt2 from hemagglutinin__InfluenzaA__ABW81526
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgaccuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93648 - RNA, 1698 nt, Artificial Sequence
  derived and/or modified sequence opt2 from hemagglutinin__InfluenzaA__ABW81527
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93649 - RNA, 1698 nt, Artificial Sequence
  derived and/or modified sequence opt2 from hemagglutinin__InfluenzaA__ABW81528
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcauccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagccccgcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93650 - RNA, 1698 nt, Artificial Sequence
  derived and/or modified sequence opt2 from hemagglutinin__InfluenzaA__ABW81529
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacauccgcgaccagaugacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagacccccaagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93651 - RNA, 1698 nt, Artificial Sequence
  derived and/or modified sequence opt2 from hemagglutinin__InfluenzaA__ABW81530
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaaccgcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93652 - RNA, 1698 nt, Artificial Sequence; identical to SEQ ID NO: 91838
  derived and/or modified sequence opt2 from hemagglutinin__InfluenzaA__ABW81531

SEQ ID NO: 93653 - RNA, 1698 nt, Artificial Sequence
  derived and/or modified sequence opt2 from hemagglutinin__InfluenzaA__ABW81532
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccugguacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcaaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93654 - RNA, 1698 nt, Artificial Sequence; identical to SEQ ID NO: 93468
  derived and/or modified sequence opt2 from hemagglutinin__InfluenzaA__ABW86321

SEQ ID NO: 93655 - RNA, 1698 nt, Artificial Sequence; identical to SEQ ID NO: 93433
  derived and/or modified sequence opt2 from hemagglutinin__InfluenzaA__ABW86332

SEQ ID NO: 93656 - RNA, 1698 nt, Artificial Sequence; identical to SEQ ID NO: 93422
  derived and/or modified sequence opt2 from hemagglutinin__InfluenzaA__ABW86343

SEQ ID NO: 93657 - RNA, 1698 nt, Artificial Sequence; identical to SEQ ID NO: 93426
  derived and/or modified sequence opt2 from hemagglutinin__InfluenzaA__ABW86354

SEQ ID NO: 93658 - RNA, 1698 nt, Artificial Sequence; identical to SEQ ID NO: 93426
  derived and/or modified sequence opt2 from hemagglutinin__InfluenzaA__ABW86365

SEQ ID NO: 93659 - RNA, 1698 nt, Artificial Sequence; identical to SEQ ID NO: 93442
  derived and/or modified sequence opt2 from hemagglutinin__InfluenzaA__ABW86376

SEQ ID NO: 93660 - RNA, 1698 nt, Artificial Sequence; identical to SEQ ID NO: 93426
  derived and/or modified sequence opt2 from hemagglutinin__InfluenzaA__ABW86387

SEQ ID NO: 93661 - RNA, 1698 nt, Artificial Sequence; identical to SEQ ID NO: 93422
  derived and/or modified sequence opt2 from hemagglutinin__InfluenzaA__ABW86409

SEQ ID NO: 93662 - RNA, 1698 nt, Artificial Sequence; identical to SEQ ID NO: 93422
  derived and/or modified sequence opt2 from hemagglutinin__InfluenzaA__ABW86431

SEQ ID NO: 93663 - RNA, 1698 nt, Artificial Sequence; identical to SEQ ID NO: 93426
  derived and/or modified sequence opt2 from hemagglutinin__InfluenzaA__ABW86442

SEQ ID NO: 93664 - RNA, 1698 nt, Artificial Sequence; identical to SEQ ID NO: 93442
  derived and/or modified sequence opt2 from hemagglutinin__InfluenzaA__ABW86453

SEQ ID NO: 93665 - RNA, 1698 nt, Artificial Sequence; identical to SEQ ID NO: 93426
  derived and/or modified sequence opt2 from hemagglutinin__InfluenzaA__ABW86464

SEQ ID NO: 93666 - RNA, 1698 nt, Artificial Sequence; identical to SEQ ID NO: 93442
  derived and/or modified sequence opt2 from hemagglutinin__InfluenzaA__ABW86475

SEQ ID NO: 93667 - RNA, 1698 nt, Artificial Sequence; identical to SEQ ID NO: 93422
  derived and/or modified sequence opt2 from hemagglutinin__InfluenzaA__ABW86486

SEQ ID NO: 93668 - RNA, 1698 nt, Artificial Sequence; identical to SEQ ID NO: 93468
  derived and/or modified sequence opt2 from hemagglutinin__InfluenzaA__ABW86497

SEQ ID NO: 93669 - RNA, 1698 nt, Artificial Sequence; identical to SEQ ID NO: 93426
  derived and/or modified sequence opt2 from hemagglutinin__InfluenzaA__ABW86508

SEQ ID NO: 93670 - RNA, 1698 nt, Artificial Sequence
  derived and/or modified sequence opt2 from hemagglutinin__InfluenzaA__ABW86519
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93671 - RNA, 1698 nt, Artificial Sequence; identical to SEQ ID NO: 93422
  derived and/or modified sequence opt2 from hemagglutinin__InfluenzaA__ABW86530

SEQ ID NO: 93672 - RNA, 1698 nt, Artificial Sequence
  derived and/or modified sequence opt2 from hemagglutinin__InfluenzaA__ABW86541
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcucaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93673 - RNA, 1698 nt, Artificial Sequence; identical to SEQ ID NO: 93422
  derived and/or modified sequence opt2 from hemagglutinin__InfluenzaA__ABW86552

SEQ ID NO: 93674 - RNA, 1701 nt, Artificial Sequence
  derived and/or modified sequence opt2 from hemagglutinin__InfluenzaA__ABW86563
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggccacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93675 - RNA, 1698 nt, Artificial Sequence; identical to SEQ ID NO: 93459
  derived and/or modified sequence opt2 from hemagglutinin__InfluenzaA__ABW86606

SEQ ID NO: 93676 - RNA, 1701 nt, Artificial Sequence; identical to SEQ ID NO: 92433
  derived and/or modified sequence opt2 from hemagglutinin__InfluenzaA__ABW91185

SEQ ID NO: 93677 - RNA, 1701 nt, Artificial Sequence
  derived and/or modified sequence opt2 from hemagglutinin__InfluenzaA__ABW91196
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93678 - RNA, 1701 nt, Artificial Sequence; identical to SEQ ID NO: 93677
  derived and/or modified sequence opt2 from hemagglutinin__InfluenzaA__ABW91207

SEQ ID NO: 93679 - RNA, 1698 nt, Artificial Sequence; identical to SEQ ID NO: 93422
  derived and/or modified sequence opt2 from hemagglutinin__InfluenzaA__ABW91218

SEQ ID NO: 93680 - RNA, 1701 nt, Artificial Sequence; identical to SEQ ID NO: 93440
  derived and/or modified sequence opt2 from hemagglutinin__InfluenzaA__ABW91240

SEQ ID NO: 93681 - RNA, 1701 nt, Artificial Sequence
  derived and/or modified sequence opt2 from hemagglutinin__InfluenzaA__ABW91251
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaaguccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93682 - RNA, 1701 nt, Artificial Sequence; identical to SEQ ID NO: 93440
  derived and/or modified sequence opt2 from hemagglutinin__InfluenzaA__ABW91262

SEQ ID NO: 93683 - RNA, 1698 nt, Artificial Sequence; identical to SEQ ID NO: 93457
  derived and/or modified sequence opt2 from hemagglutinin__InfluenzaA__ABW91273

SEQ ID NO: 93684 - RNA, 1698 nt, Artificial Sequence
  derived and/or modified sequence opt2 from hemagglutinin__InfluenzaA__ABW91284
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgccuccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93685 - RNA, 1698 nt, Artificial Sequence; identical to SEQ ID NO: 93457
  derived and/or modified sequence opt2 from hemagglutinin__InfluenzaA__ABW91295

SEQ ID NO: 93686 - RNA, 1698 nt, Artificial Sequence; identical to SEQ ID NO: 93426
  derived and/or modified sequence opt2 from hemagglutinin__InfluenzaA__ABW91306

SEQ ID NO: 93687 - RNA, 1698 nt, Artificial Sequence; identical to SEQ ID NO: 93426
  derived and/or modified sequence opt2 from hemagglutinin__InfluenzaA__ABW91317

SEQ ID NO: 93688 - RNA, 1698 nt, Artificial Sequence
  derived and/or modified sequence opt2 from hemagglutinin__InfluenzaA__ABW91328
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93689 - RNA, 1698 nt, Artificial Sequence; identical to SEQ ID NO: 93426
  derived and/or modified sequence opt2 from hemagglutinin__InfluenzaA__ABW91339

SEQ ID NO: 93690 - RNA, 1698 nt, Artificial Sequence; identical to SEQ ID NO: 93426
  derived and/or modified sequence opt2 from hemagglutinin__InfluenzaA__ABW91350

SEQ ID NO: 93691 - RNA, 1698 nt, Artificial Sequence
  derived and/or modified sequence opt2 from hemagglutinin__InfluenzaA__ABW91361
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagacccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93692 - RNA, 1698 nt, Artificial Sequence; identical to SEQ ID NO: 93426
  derived and/or modified sequence opt2 from hemagglutinin__InfluenzaA__ABW91372

SEQ ID NO: 93693 - RNA, 1698 nt, Artificial Sequence; identical to SEQ ID NO: 93459
  derived and/or modified sequence opt2 from hemagglutinin__InfluenzaA__ABW91383

SEQ ID NO: 93694 - RNA, 1701 nt, Artificial Sequence; identical to SEQ ID NO: 93499
  derived and/or modified sequence opt2 from hemagglutinin__InfluenzaA__ABW91394

SEQ ID NO: 93695 - RNA, 1698 nt, Artificial Sequence; identical to SEQ ID NO: 93468
  derived and/or modified sequence opt2 from hemagglutinin__InfluenzaA__ABW91405

SEQ ID NO: 93696 - RNA, 1698 nt, Artificial Sequence
  derived and/or modified sequence opt2 from hemagglutinin__InfluenzaA__ABW91416
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93697 - RNA, 1698 nt, Artificial Sequence; identical to SEQ ID NO: 93571
  derived and/or modified sequence opt2 from hemagglutinin__InfluenzaA__ABW91427

SEQ ID NO: 93698 - RNA, 1701 nt, Artificial Sequence; identical to SEQ ID NO: 93440
  derived and/or modified sequence opt2 from hemagglutinin__InfluenzaA__ABW91438

SEQ ID NO: 93699 - RNA, 1698 nt, Artificial Sequence; identical to SEQ ID NO: 93468
  derived and/or modified sequence opt2 from hemagglutinin__InfluenzaA__ABW91449

SEQ ID NO: 93700 - RNA, 1698 nt, Artificial Sequence; identical to SEQ ID NO: 93468
  derived and/or modified sequence opt2 from hemagglutinin__InfluenzaA__ABW91460

SEQ ID NO: 93701 - RNA, 1698 nt, Artificial Sequence
  derived and/or modified sequence opt2 from hemagglutinin__InfluenzaA__ABW91471
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcgucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93702 - RNA, 1698 nt, Artificial Sequence
  derived and/or modified sequence opt2 from hemagglutinin__InfluenzaA__ABW91482
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggccgcuccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93703 - RNA, 1698 nt, Artificial Sequence
  derived and/or modified sequence opt2 from hemagglutinin__InfluenzaA__ABW91493
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93704 - RNA, 1698 nt, Artificial Sequence; identical to SEQ ID NO: 93442
  derived and/or modified sequence opt2 from hemagglutinin__InfluenzaA__ABW91504

SEQ ID NO: 93705 - RNA, 1698 nt, Artificial Sequence
  derived and/or modified sequence opt2 from hemagglutinin__InfluenzaA__ABW91515
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacgucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93706 - RNA, 1698 nt, Artificial Sequence
  derived and/or modified sequence opt2 from hemagglutinin__InfluenzaA__ABW91526
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgagcaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccacccgccuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93707 - RNA, 1698 nt, Artificial Sequence; identical to SEQ ID NO: 93426
  derived and/or modified sequence opt2 from hemagglutinin__InfluenzaA__ABW91537

SEQ ID NO: 93708 - RNA, 1701 nt, Artificial Sequence; identical to SEQ ID NO: 93499
  derived and/or modified sequence opt2 from hemagglutinin__InfluenzaA__ABW91548

SEQ ID NO: 93709 - RNA, 1698 nt, Artificial Sequence
  derived and/or modified sequence opt2 from hemagglutinin__InfluenzaA__ABW91559
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucuaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93710 - RNA, 1698 nt, Artificial Sequence; identical to SEQ ID NO: 93567
  derived and/or modified sequence opt2 from hemagglutinin__InfluenzaA__ABW91570

SEQ ID NO: 93711 - RNA, 1698 nt, Artificial Sequence; identical to SEQ ID NO: 93442
  derived and/or modified sequence opt2 from hemagglutinin__InfluenzaA__ABW91581

SEQ ID NO: 93712 - RNA, 1698 nt, Artificial Sequence; identical to SEQ ID NO: 93422
  derived and/or modified sequence opt2 from hemagglutinin__InfluenzaA__ABW91592

SEQ ID NO: 93713 - RNA, 1698 nt, Artificial Sequence; identical to SEQ ID NO: 93468
  derived and/or modified sequence opt2 from hemagglutinin__InfluenzaA__ABW91603

SEQ ID NO: 93714 - RNA, 1698 nt, Artificial Sequence
  derived and/or modified sequence opt2 from hemagglutinin__InfluenzaA__ABW91614
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccucccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucuccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93715 - RNA, 1698 nt, Artificial Sequence; identical to SEQ ID NO: 93457
  derived and/or modified sequence opt2 from hemagglutinin__InfluenzaA__ABW91625

SEQ ID NO: 93716 - RNA, 1698 nt, Artificial Sequence; identical to SEQ ID NO: 93426
  derived and/or modified sequence opt2 from hemagglutinin__InfluenzaA__ABW91636

SEQ ID NO: 93717 - RNA, 1701 nt, Artificial Sequence; identical to SEQ ID NO: 93499
  derived and/or modified sequence opt2 from hemagglutinin__InfluenzaA__ABW91647

SEQ ID NO: 93718 - RNA, 1707 nt, Artificial Sequence
  derived and/or modified sequence opt2 from hemagglutinin__InfluenzaA__ABX10515
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggucucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcucaaggacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 93719 - RNA, 1701 nt, Artificial Sequence; identical to SEQ ID NO: 93368
  derived and/or modified sequence opt2 from hemagglutinin__InfluenzaA__ABX10525

SEQ ID NO: 93720 - RNA, 1698 nt, Artificial Sequence; identical to SEQ ID NO: 93426
  derived and/or modified sequence opt2 from hemagglutinin__InfluenzaA__ABX58239

SEQ ID NO: 93721 - RNA, 1698 nt, Artificial Sequence; identical to SEQ ID NO: 93526
  derived and/or modified sequence opt2 from hemagglutinin__InfluenzaA__ABX58250

SEQ ID NO: 93722 - RNA, 1698 nt, Artificial Sequence
  derived and/or modified sequence opt2 from hemagglutinin__InfluenzaA__ABX58261
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggucccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93723 - RNA, 1698 nt, Artificial Sequence
  derived and/or modified sequence opt2 from hemagglutinin__InfluenzaA__ABX58272
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagaaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93724 - RNA, 1698 nt, Artificial Sequence; identical to SEQ ID NO: 93426
  derived and/or modified sequence opt2 from hemagglutinin__InfluenzaA__ABX58283

SEQ ID NO: 93725 - RNA, 1698 nt, Artificial Sequence; identical to SEQ ID NO: 93567
  derived and/or modified sequence opt2 from hemagglutinin__InfluenzaA__ABX58294

SEQ ID NO: 93726 - RNA, 1698 nt, Artificial Sequence; identical to SEQ ID NO: 93422
  derived and/or modified sequence opt2 from hemagglutinin__InfluenzaA__ABX58316

SEQ ID NO: 93727 - RNA, 1698 nt, Artificial Sequence; identical to SEQ ID NO: 93571
  derived and/or modified sequence opt2 from hemagglutinin__InfluenzaA__ABX58327

SEQ ID NO: 93728 - RNA, 1698 nt, Artificial Sequence; identical to SEQ ID NO: 93422
  derived and/or modified sequence opt2 from hemagglutinin__InfluenzaA__ABX58338

SEQ ID NO: 93729 - RNA, 1698 nt, Artificial Sequence
  derived and/or modified sequence opt2 from hemagglutinin__InfluenzaA__ABX58360
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgcccccauccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacggcugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93730 - RNA, 1698 nt, Artificial Sequence; identical to SEQ ID NO: 93426
  derived and/or modified sequence opt2 from hemagglutinin__InfluenzaA__ABX58371

SEQ ID NO: 93731 - RNA, 1698 nt, Artificial Sequence; identical to SEQ ID NO: 93426
  derived and/or modified sequence opt2 from hemagglutinin__InfluenzaA__ABX58382

SEQ ID NO: 93732 - RNA, 1698 nt, Artificial Sequence; identical to SEQ ID NO: 93567
  derived and/or modified sequence opt2 from hemagglutinin__InfluenzaA__ABX58393

SEQ ID NO: 93733 - RNA, 1698 nt, Artificial Sequence; identical to SEQ ID NO: 93426
  derived and/or modified sequence opt2 from hemagglutinin__InfluenzaA__ABX58404

SEQ ID NO: 93734 - RNA, 1698 nt, Artificial Sequence
  derived and/or modified sequence opt2 from hemagglutinin__InfluenzaA__ABX58415
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaagaaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93735 - RNA, 1698 nt, Artificial Sequence; identical to SEQ ID NO: 93426
  derived and/or modified sequence opt2 from hemagglutinin__InfluenzaA__ABX58426

SEQ ID NO: 93736 - RNA, 1698 nt, Artificial Sequence; identical to SEQ ID NO: 93426
  derived and/or modified sequence opt2 from hemagglutinin__InfluenzaA__ABX58437

SEQ ID NO: 93737 - RNA, 1698 nt, Artificial Sequence; identical to SEQ ID NO: 93422
  derived and/or modified sequence opt2 from hemagglutinin__InfluenzaA__ABX58448

SEQ ID NO: 93738 - RNA, 1698 nt, Artificial Sequence; identical to SEQ ID NO: 93468
  derived and/or modified sequence opt2 from hemagglutinin__InfluenzaA__ABX58459

SEQ ID NO: 93739 - RNA, 1698 nt, Artificial Sequence; identical to SEQ ID NO: 93567
  derived and/or modified sequence opt2 from hemagglutinin__InfluenzaA__ABX58470

SEQ ID NO: 93740 - RNA, 1698 nt, Artificial Sequence; identical to SEQ ID NO: 93468
  derived and/or modified sequence opt2 from hemagglutinin__InfluenzaA__ABX58481

SEQ ID NO: 93741 - RNA, 1698 nt, Artificial Sequence; identical to SEQ ID NO: 93426
  derived and/or modified sequence opt2 from hemagglutinin__InfluenzaA__ABX58492

SEQ ID NO: 93742 - RNA, 1698 nt, Artificial Sequence; identical to SEQ ID NO: 93442
  derived and/or modified sequence opt2 from hemagglutinin__InfluenzaA__ABX58503

SEQ ID NO: 93743 - RNA, 1698 nt, Artificial Sequence; identical to SEQ ID NO: 93468
  derived and/or modified sequence opt2 from hemagglutinin__InfluenzaA__ABX58525

SEQ ID NO: 93744 - RNA, 1698 nt, Artificial Sequence
  derived and/or modified sequence opt2 from hemagglutinin__InfluenzaA__ABX58536
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggagcccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93745 - RNA, 1698 nt, Artificial Sequence
  derived and/or modified sequence opt2 from hemagglutinin__InfluenzaA__ABX58547
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagacccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93746 - RNA, 1698 nt, Artificial Sequence
  derived and/or modified sequence opt2 from hemagglutinin__InfluenzaA__ABX58558
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggccgcuccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93747 - RNA, 1698 nt, Artificial Sequence
  derived and/or modified sequence opt2 from hemagglutinin__InfluenzaA__ABX58569
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93748 - RNA, 1698 nt, Artificial Sequence; identical to SEQ ID NO: 93422
  derived and/or modified sequence opt2 from hemagglutinin__InfluenzaA__ABX58580

SEQ ID NO: 93749 - RNA, 1698 nt, Artificial Sequence; identical to SEQ ID NO: 93426
  derived and/or modified sequence opt2 from hemagglutinin__InfluenzaA__ABX58591

SEQ ID NO: 93750 - RNA, 1698 nt, Artificial Sequence
  derived and/or modified sequence opt2 from hemagglutinin__InfluenzaA__ABX58602
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucgagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagccccgcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93751 - RNA, 1698 nt, Artificial Sequence; identical to SEQ ID NO: 93459
  derived and/or modified sequence opt2 from hemagglutinin__InfluenzaA__ABX58613

SEQ ID NO: 93752 - RNA, 1698 nt, Artificial Sequence; identical to SEQ ID NO: 93426
  derived and/or modified sequence opt2 from hemagglutinin__InfluenzaA__ABX58624

SEQ ID NO: 93753 - RNA, 1698 nt, Artificial Sequence
  derived and/or modified sequence opt2 from hemagglutinin__InfluenzaA__ABX58635
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggccgcuccuccuucuaccgcaaccuccucuggcucaccggcaagaacggccucuaccccucccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93754 - RNA, 1698 nt, Artificial Sequence; identical to SEQ ID NO: 93422
  derived and/or modified sequence opt2 from hemagglutinin__InfluenzaA__ABX58679

SEQ ID NO: 93755 - RNA, 1698 nt, Artificial Sequence; identical to SEQ ID NO: 93468
  derived and/or modified sequence opt2 from hemagglutinin__InfluenzaA__ABX58701

SEQ ID NO: 93756 - RNA, 1698 nt, Artificial Sequence; identical to SEQ ID NO: 93526
  derived and/or modified sequence opt2 from hemagglutinin__InfluenzaA__ABX58712

SEQ ID NO: 93757 - RNA, 1704 nt, Artificial Sequence
  derived and/or modified sequence opt2 from hemagglutinin__InfluenzaA__ABY19417
auggagaagaucguccuccuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcguccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucaaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcauccgcaucuga

SEQ ID NO: 93758 - RNA, 1704 nt, Artificial Sequence
  derived and/or modified sequence opt2 from hemagglutinin__InfluenzaA__ABY19418
auggagaagaucguccuccuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcgacuucaacgacuacgaggagcucaagcaccuccucucccgcaucaaccacuucgagaagauccagaucauccccaaguccuccugguccgaccacgaggccuccuccggcgucuccuccgccugccccuaccagggcguccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuuccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93759 - RNA, 1704 nt, Artificial Sequence
  derived and/or modified sequence opt2 from hemagglutinin__InfluenzaA__ABY19419
auggagaagaucguccuccuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcguccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93760 - RNA, 1698 nt, Artificial Sequence; identical to SEQ ID NO: 93567
  derived and/or modified sequence opt2 from hemagglutinin__InfluenzaA__ABY51017

SEQ ID NO: 93761 - RNA, 1701 nt, Artificial Sequence; identical to SEQ ID NO: 93440
  derived and/or modified sequence opt2 from hemagglutinin__InfluenzaA__ABY51028

SEQ ID NO: 93762 - RNA, 1698 nt, Artificial Sequence
  derived and/or modified sequence opt2 from hemagglutinin__InfluenzaA__ABY51039
augaaggucaagcuccucguccuccucugcaccuucaccgccaccaacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagggccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93763 - RNA, 1698 nt, Artificial Sequence
  derived and/or modified sequence opt2 from hemagglutinin__InfluenzaA__ABY51050
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacuccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93764 - RNA, 1698 nt, Artificial Sequence; identical to SEQ ID NO: 93526
  derived and/or modified sequence opt2 from hemagglutinin__InfluenzaA__ABY51061

SEQ ID NO: 93765 - RNA, 1698 nt, Artificial Sequence
  derived and/or modified sequence opt2 from hemagglutinin__InfluenzaA__ABY51072
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggccuucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93766 - RNA, 1698 nt, Artificial Sequence; identical to SEQ ID NO: 93468
  derived and/or modified sequence opt2 from hemagglutinin__InfluenzaA__ABY51083

SEQ ID NO: 93767 - RNA, 1698 nt, Artificial Sequence; identical to SEQ ID NO: 93426
  derived and/or modified sequence opt2 from hemagglutinin__InfluenzaA__ABY51094

SEQ ID NO: 93768 - RNA, 1698 nt, Artificial Sequence; identical to SEQ ID NO: 93567
  derived and/or modified sequence opt2 from hemagglutinin__InfluenzaA__ABY51105

SEQ ID NO: 93769 - RNA, 1698 nt, Artificial Sequence; identical to SEQ ID NO: 93426
  derived and/or modified sequence opt2 from hemagglutinin__InfluenzaA__ABY51116

SEQ ID NO: 93770 - RNA, 1701 nt, Artificial Sequence
  derived and/or modified sequence opt2 from hemagglutinin__InfluenzaA__ABY51127
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccaggucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93771 - RNA, 1698 nt, Artificial Sequence
  derived and/or modified sequence opt2 from hemagglutinin__InfluenzaA__ABY51138
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagauccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93772 - RNA, 1698 nt, Artificial Sequence; identical to SEQ ID NO: 93426
  derived and/or modified sequence opt2 from hemagglutinin__InfluenzaA__ABY51149

SEQ ID NO: 93773 - RNA, 1698 nt, Artificial Sequence
  derived and/or modified sequence opt2 from hemagglutinin__InfluenzaA__ABY51160
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93774 - RNA, 1698 nt, Artificial Sequence
  derived and/or modified sequence opt2 from hemagglutinin__InfluenzaA__ABY51171
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccagaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93775 - RNA, 1698 nt, Artificial Sequence; identical to SEQ ID NO: 93422
  derived and/or modified sequence opt2 from hemagglutinin__InfluenzaA__ABY51182

SEQ ID NO: 93776 - RNA, 1698 nt, Artificial Sequence; identical to SEQ ID NO: 93442
  derived and/or modified sequence opt2 from hemagglutinin__InfluenzaA__ABY51193

SEQ ID NO: 93777 - RNA, 1698 nt, Artificial Sequence; identical to SEQ ID NO: 93426
  derived and/or modified sequence opt2 from hemagglutinin__InfluenzaA__ABY51237

SEQ ID NO: 93778 - RNA, 1698 nt, Artificial Sequence; identical to SEQ ID NO: 93442
  derived and/or modified sequence opt2 from hemagglutinin__InfluenzaA__ABY51248

SEQ ID NO: 93779 - RNA, 1698 nt, Artificial Sequence; identical to SEQ ID NO: 93422
  derived and/or modified sequence opt2 from hemagglutinin__InfluenzaA__ABY51259

SEQ ID NO: 93780 - RNA, 1701 nt, Artificial Sequence; identical to SEQ ID NO: 93499
  derived and/or modified sequence opt2 from hemagglutinin__InfluenzaA__ABY51270

SEQ ID NO: 93781 - RNA, 1707 nt, Artificial Sequence
  derived and/or modified sequence opt2 from hemagglutinin__InfluenzaA__ABY76282
auggagaagaucguccuccuccucgccaucgucucccucgucaaguccgaccagaucugcaucggcuaccacgccaacaacuccaccgagcacgucgacaccaucauggagaagaacgucaccgucacccacgcccaggacauccucgagaaggcccacaacggccgccucugcgaccucgacggcgucaagccccucauccuccgcgacugcuccgucgccggcuggcuccucggcaaccccaugugcgacgaguuccucaacguccccgagugguccuacaucgucgagaagaacaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacgacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93782 - RNA, 1701 nt, Artificial Sequence
  derived and/or modified sequence opt2 from hemagglutinin__InfluenzaA__ABY81349
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccgccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucaaggaccagaagaccaucuaccagaaggagaacgccuacgucuccgucgucuccuccaacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggaggucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93783 - RNA, 1701 nt, Artificial Sequence; identical to SEQ ID NO: 93440
  derived and/or modified sequence opt2 from hemagglutinin__InfluenzaA__ABY81371

SEQ ID NO: 93784 - RNA, 1698 nt, Artificial Sequence; identical to SEQ ID NO: 93426
  derived and/or modified sequence opt2 from hemagglutinin__InfluenzaA__ABY81382

SEQ ID NO: 93785 - RNA, 1698 nt, Artificial Sequence; identical to SEQ ID NO: 93468
  derived and/or modified sequence opt2 from hemagglutinin__InfluenzaA__ABY81393

SEQ ID NO: 93786 - RNA, 1698 nt, Artificial Sequence
  derived and/or modified sequence opt2 from hemagglutinin__InfluenzaA__ABY81415
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccucccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93787 - RNA, 1701 nt, Artificial Sequence; identical to SEQ ID NO: 93440
  derived and/or modified sequence opt2 from hemagglutinin__InfluenzaA__ACA24502

SEQ ID NO: 93788 - RNA, 1698 nt, Artificial Sequence
  derived and/or modified sequence opt2 from hemagglutinin__InfluenzaA__ACA24513
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucaacuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagccccgcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93789 - RNA, 1698 nt, Artificial Sequence; identical to SEQ ID NO: 93426
  derived and/or modified sequence opt2 from hemagglutinin__InfluenzaA__ACA24524

SEQ ID NO: 93790 - RNA, 1701 nt, Artificial Sequence
  derived and/or modified sequence opt2 from hemagglutinin__InfluenzaA__ACA24689
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93791 - RNA, 1701 nt, Artificial Sequence
  derived and/or modified sequence opt2 from hemagglutinin__InfluenzaA__ACA24700
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcucccaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93792 - RNA, 1698 nt, Artificial Sequence
  derived and/or modified sequence opt2 from hemagglutinin__InfluenzaA__ACA28846
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcauccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93793 - RNA, 1701 nt, Artificial Sequence
  derived and/or modified sequence opt2 from hemagglutinin__InfluenzaA__ACA33749
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93794 - RNA, 1698 nt, Artificial Sequence; identical to SEQ ID NO: 93422
  derived and/or modified sequence opt2 from hemagglutinin__InfluenzaA__ACA96519

SEQ ID NO: 93795 - RNA, 1659 nt, Artificial Sequence
  derived and/or modified sequence opt2 from hemagglutinin__InfluenzaA__ACC55270
augaacacccagauccucgccuucaucgccugcguccucaccggcgucaagggcgacaagaucugccucggccaccacgccgucgccaacggcaccaaggucaacacccucaccgagcgcggcaucgaggucgucaacgccaccgagaccgucgagaccaccaacaucaagaagaucugcacccagggcaagcgccccaccgaccucggccagugcggccuccucggcacccucaucggccccccccagugcgaccaguuccucgaguucuccuccgaccucaucaucgagcgccgcgagggcaccgacaucugcuaccccggccgcuucaccaacgaggagucccuccgccagauccuccgccgcuccggcggcaucggcaaggaguccaugggcuucaccuacuccggcauccgcaccaacggcgccaccuccgccugcacccgcuccggcuccuccuucuacgccgagaugaaguggcuccucuccaacuccgacaacgccgccuucccccagaugaccaaggccuaccgcaacccccgcaacaagcccgcccucaucaucuggggcguccaccacuccgaguccgucuccgagcagaccaagcucuacggcuccggcaacaagcucaucaccguccgcuccuccaaguaccagcaguccuucacccccaaccccggcgcccgccgcaucgacuuccacuggcuccuccucgaccccaacgacaccgucaccuucaccuucaacggcgccuucaucgcccccgaccgcaccuccuucuuccgcggcgagucccucggcguccaguccgacgccccccucgacuccuccugccgcggcgacugcuuccacuccggcggcaccaucgucuccucccuccccuuccagaacaucaacucccgcaccgucggcaagugcccccgcuacgucaagcagaagucccuccuccucgccaccggcaugcgcaacguccccgagaagcccaagccccgcggccucuucggcgccaucgccggcuucaucgagaacggcugggagggccucaucaacggcugguacggcuuccgccaccagaacgcccagggcgagggcaccgccgccgacuacaaguccacccaguccgccaucgaccagaucaccggcaagcucaaccgccucaucggcaagaccaaccagcaguucgagcucaucgacaacgaguucaacgagaucgagcagcagaucggcaacgucaucaacuggacccgcgacgccaugaccgagaucugguccuacaacgccgagcuccucgucgccauggagaaccagcacaccaucgaccucgccgacuccgagauguccaagcucuacgagcgcgucaagaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucgaccccgucaagcucuccuccggcuacaaggacaucauccucugguucuccuucggcgccuccugcuuccuccuccucgccaucgccaugggccucgucuucaucugcaucaagaacggcaacaugcagugcaccaucugcaucuga

SEQ ID NO: 93796 - RNA, 1698 nt, Artificial Sequence; identical to SEQ ID NO: 93426
  derived and/or modified sequence opt2 from hemagglutinin__InfluenzaA__ACC61964

SEQ ID NO: 93797 - RNA, 1698 nt, Artificial Sequence
  derived and/or modified sequence opt2 from hemagglutinin__InfluenzaA__ACC61975
augaaggucaagcuccucguccuccucugcaccuucaccgccuccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagguccccaaccccgagaacggcaccugcuaccccggcuacuucgccgacuacgaggagcuccgcgagcagcucuccuccaucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggccucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93798 - RNA, 1698 nt, Artificial Sequence; identical to SEQ ID NO: 93422
  derived and/or modified sequence opt2 from hemagglutinin__InfluenzaA__ACC61986

SEQ ID NO: 93799 - RNA, 1698 nt, Artificial Sequence
  derived and/or modified sequence opt2 from hemagglutinin__InfluenzaA__ACD37430
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccacccacaccgucaccggcgucuccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93800 - RNA, 1698 nt, Artificial Sequence
  derived and/or modified sequence opt2 from hemagglutinin__InfluenzaA__ACD37507
augaaggccaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93801 - RNA, 1698 nt, Artificial Sequence; identical to SEQ ID NO: 93567
  derived and/or modified sequence opt2 from hemagglutinin__InfluenzaA__ACD56113

SEQ ID NO: 93802 - RNA, 1698 nt, Artificial Sequence; identical to SEQ ID NO: 93426
  derived and/or modified sequence opt2 from hemagglutinin__InfluenzaA__ACD56124

SEQ ID NO: 93803 - RNA, 1701 nt, Artificial Sequence; identical to SEQ ID NO: 93499
  derived and/or modified sequence opt2 from hemagglutinin__InfluenzaA__ACD56258

SEQ ID NO: 93804 - RNA, 1701 nt, Artificial Sequence; identical to SEQ ID NO: 93241
  derived and/or modified sequence opt2 from hemagglutinin__InfluenzaA__ACD56269

SEQ ID NO: 93805 - RNA, 1698 nt, Artificial Sequence
  derived and/or modified sequence opt2 from hemagglutinin__InfluenzaA__ACD56280
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccggcaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgaggccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93806 - RNA, 1689 nt, Artificial Sequence
  derived and/or modified sequence opt2 from hemagglutinin__InfluenzaA__ACD56324
auggccaucaucuaccucauccuccucuucaccgccguccgcggcgaccagaucugcaucggcuaccacgccaacaacuccaccgagaaggucgacaccauccucgagcgcaacgucaccgucacccacgccaagaacauccucgagaagacccacaacggccgccucugcaagcucaacggcauccccccccucgagcucggcgacugcuccaucgccggcuggcuccucggcaaccccgagugcgaccgccuccuccgcguccccgagugguccuacaucauggagaaggagaacccccgcaacggccucugcuaccccggcuccuucaacgacuacgaggagcucaagcaccuccucuccuccgucaagcacuucgagaagguccgcauccuccccaaggaccgcuggacccagcacaccaccaccggcuccucccgcgccugcgccgucuccggcaaccccuccuucuuccgcaacauggucuggcucaccaagaaggaguccaacuaccccgucgccaagggcuccuacaacaacaccuccggcgagcagaugcucaucaucuggggcguccaccaccccaucgacgagaccgagcagcgcacccucuaccagaacgucggcaccuacgucuccgucggcaccuccacccucaacaagcgcuccacccccgacaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagcgcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagccccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93807 - RNA, 1689 nt, Artificial Sequence
  derived and/or modified sequence opt2 from hemagglutinin__InfluenzaA__ACD85187
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggaccgcuggacccagcacaccaccaccggcggcuccaaggccugcgccgucuccggcaagcccuccuucuuccgcaacauggucuggcucaccaagaagggccccaacuaccccgucgccaagggcuccuacaacaacaccuccggcgagcagaugcucaucaucuggggcguccaccaccccaaggacgaggccgagcagcgcgcccucuaccaggaggucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93808 - RNA, 1689 nt, Artificial Sequence
  derived and/or modified sequence opt2 from hemagglutinin__InfluenzaA__ACD85198
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacaccaccaccggcggcuccaaggccugcgccgucuccggcaagcccuccuucuuccgcaacauggucuggcucaccaagaagggccccaacuaccccgucgccaagcgcuccuacaacaacaccuccggcgagcagaugcucaucaucuggggcguccaccaccccaccgacgaggccgagcagcgcgcccucuaccaggaggucggcaccuacgucuccgccuccaccuccacccucaacaagcgcuccacccccgagaucgccgcccgccccgaggucaacggccuccgcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucggcuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93809 - RNA, 1689 nt, Artificial Sequence
  derived and/or modified sequence opt2 from hemagglutinin__InfluenzaA__ACD85209
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucacccagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93810 - RNA, 1689 nt, Artificial Sequence
  derived and/or modified sequence opt2 from hemagglutinin__InfluenzaA__ACD85220
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaaccccaaguacucccucugcuaccccggcuccuucaacgacuacgaggagcucaagcaccuccucuccuccgucaagcacuucgagaaggucaagauccuccccaaggaccgcuggacccagcacaccaccaccggcggcuccaaggccugcgccgucuccggcgagcccuccuucuuccgcaacauggucuggcucaccaagaagggccccaacuaccccgucgccaagggcuccuacaacaacaccuccggcgagcagaugcucaucaucuggggcguccaccaccccaaggacgaggccgagcagcgcgcccucuaccagaacgucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgagaaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93811 - RNA, 1689 nt, Artificial Sequence
  derived and/or modified sequence opt2 from hemagglutinin__InfluenzaA__ACD85242
auggccaucaucuaccucauccuccucuucgccaccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcucccucaacgacuacgaggagcucaagcaccuccucuccuccgucaagcacuucgagaagguccgcauccuccccaaggaccgcuggacccagcacaccaccaccggcggcuccaaggccugcgccgucuccggcaagcccuccuucuuccgcaacauggucuggcucaccaagaagggccccaacuaccccgucgccaagggcuccuacaacaacaccuccggcgagcagaugcucaucaucuggggcguccaccaccccaaggacgaggccgagcagcgcgcccucuaccaggaggucggcaccuacgucuccgccuccaccuccacccucaacaagcgcuccauccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccaugaucgagaagaugaacacccaguucgaggccgucggcaaggaguucaacaaccucgagaagcgccucgagaaccucgacaagaagauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacgucaaggagcucggcaacggcugcuucgaguucuaccacaagugcgacaacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucauggucgccggcaucuccuucuggaugugcuccaacggcucccuccagugccgcaucugcaucuga

SEQ ID NO: 93812 - RNA, 1689 nt, Artificial Sequence
  derived and/or modified sequence opt2 from hemagglutinin__InfluenzaA__ACD85253
auggccaucaucuaccucauccuccucuucgccaccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacaaccucugcuaccccggcucccucaacgaguacgaggagcucaagcaccuccucuccuccgucaagcacuucgagaagguccgcauccuccccaaggaccgcuggacccagcacaccaccaccggcggcuccaaggccugcgccgucuccggcgagcccuccuucuuccgcaacauggucuggcucaccaagaagggccccaacuaccccgucgccaagggcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccauccccgagaucgccgcccgccccaaggucaacggccucggcucccgcauggaguucuucuggacccuccucgacgucugggacaccaucaacuucgaguccaccggcaaccucgucguccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgagaccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucauggucgccggcaucuccuucuggaugugcuccaacggcucccuccagugccgcaucugcaucuga

SEQ ID NO: 93813 - RNA, 1701 nt, Artificial Sequence
  derived and/or modified sequence opt2 from hemagglutinin__InfluenzaA__ACD85440
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggaccucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93814 - RNA, 1701 nt, Artificial Sequence; identical to SEQ ID NO: 93813
  derived and/or modified sequence opt2 from hemagglutinin__InfluenzaA__ACD85451

SEQ ID NO: 93815 - RNA, 1701 nt, Artificial Sequence; identical to SEQ ID NO: 93813
  derived and/or modified sequence opt2 from hemagglutinin__InfluenzaA__ACD85462

SEQ ID NO: 93816 - RNA, 1701 nt, Artificial Sequence; identical to SEQ ID NO: 93440
  derived and/or modified sequence opt2 from hemagglutinin__InfluenzaA__ACD85473

SEQ ID NO: 93817 - RNA, 1701 nt, Artificial Sequence
  derived and/or modified sequence opt2 from hemagglutinin__InfluenzaA__ACD85484
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93818 - RNA, 1701 nt, Artificial Sequence; identical to SEQ ID NO: 93440
  derived and/or modified sequence opt2 from hemagglutinin__InfluenzaA__ACD85495

SEQ ID NO: 93819 - RNA, 1701 nt, Artificial Sequence
  derived and/or modified sequence opt2 from hemagglutinin__InfluenzaA__ACD85528
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccaacaaguccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggaccucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93820 - RNA, 1701 nt, Artificial Sequence
  derived and/or modified sequence opt2 from hemagglutinin__InfluenzaA__ACD85539
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcaccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93821 - RNA, 1701 nt, Artificial Sequence
  derived and/or modified sequence opt2 from hemagglutinin__InfluenzaA__ACD85550
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggaccucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 93822 - RNA, 1701 nt, Artificial Sequence; identical to SEQ ID NO: 93440
  derived and/or modified sequence opt2 from hemagglutinin__InfluenzaA__ACD85561

SEQ ID NO: 93823 - RNA, 1701 nt, Artificial Sequence
  derived and/or modified sequence opt2 from hemagglutinin__InfluenzaA__ACD85572
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaccggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93824 - RNA, 1701 nt, Artificial Sequence; identical to SEQ ID NO: 93820
  derived and/or modified sequence opt2 from hemagglutinin__InfluenzaA__ACD85583

SEQ ID NO: 93825 - RNA, 1701 nt, Artificial Sequence
  derived and/or modified sequence opt2 from hemagglutinin__InfluenzaA__ACD93579
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93826 - RNA, 1701 nt, Artificial Sequence; identical to SEQ ID NO: 92142
  derived and/or modified sequence opt2 from hemagglutinin__InfluenzaA__ACF09402

SEQ ID NO: 93827 - RNA, 1701 nt, Artificial Sequence
  derived and/or modified sequence opt2 from hemagglutinin__InfluenzaA__ACF22159
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcuuccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93828 - RNA, 1701 nt, Artificial Sequence
  derived and/or modified sequence opt2 from hemagglutinin__InfluenzaA__ACF22188
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucuggucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaacuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93829 - RNA, 1701 nt, Artificial Sequence; identical to SEQ ID NO: 93828
  derived and/or modified sequence opt2 from hemagglutinin__InfluenzaA__ACF22199

SEQ ID NO: 93830 - RNA, 1701 nt, Artificial Sequence
  derived and/or modified sequence opt2 from hemagglutinin__InfluenzaA__ACF22210
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93831 - RNA, 1701 nt, Artificial Sequence; identical to SEQ ID NO: 93830
  derived and/or modified sequence opt2 from hemagglutinin__InfluenzaA__ACF22221

SEQ ID NO: 93832 - RNA, 1701 nt, Artificial Sequence; identical to SEQ ID NO: 93830
  derived and/or modified sequence opt2 from hemagglutinin__InfluenzaA__ACF22232

SEQ ID NO: 93833 - RNA, 1701 nt, Artificial Sequence; identical to SEQ ID NO: 93830
  derived and/or modified sequence opt2 from hemagglutinin__InfluenzaA__ACF22243

SEQ ID NO: 93834 - RNA, 1701 nt, Artificial Sequence; identical to SEQ ID NO: 93830
  derived and/or modified sequence opt2 from hemagglutinin__InfluenzaA__ACF22254

SEQ ID NO: 93835 - RNA, 1701 nt, Artificial Sequence; identical to SEQ ID NO: 93830
  derived and/or modified sequence opt2 from hemagglutinin__InfluenzaA__ACF22265

SEQ ID NO: 93836 - RNA, 1701 nt, Artificial Sequence; identical to SEQ ID NO: 93830
  derived and/or modified sequence opt2 from hemagglutinin__InfluenzaA__ACF22276

SEQ ID NO: 93837 - RNA, 1701 nt, Artificial Sequence; identical to SEQ ID NO: 93830
  derived and/or modified sequence opt2 from hemagglutinin__InfluenzaA__ACF22287

SEQ ID NO: 93838 - RNA, 1701 nt, Artificial Sequence; identical to SEQ ID NO: 93830
  derived and/or modified sequence opt2 from hemagglutinin__InfluenzaA__ACF22298

SEQ ID NO: 93839 - RNA, 1701 nt, Artificial Sequence; identical to SEQ ID NO: 93830
  derived and/or modified sequence opt2 from hemagglutinin__InfluenzaA__ACF22320

SEQ ID NO: 93840 - RNA, 1701 nt, Artificial Sequence; identical to SEQ ID NO: 93830
  derived and/or modified sequence opt2 from hemagglutinin__InfluenzaA__ACF22342

SEQ ID NO: 93841 - RNA, 1701 nt, Artificial Sequence
  derived and/or modified sequence opt2 from hemagglutinin__InfluenzaA__ACF22364
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93842 - RNA, 1701 nt, Artificial Sequence; identical to SEQ ID NO: 93820
  derived and/or modified sequence opt2 from hemagglutinin__InfluenzaA__ACF22408

SEQ ID NO: 93843 - RNA, 1701 nt, Artificial Sequence; identical to SEQ ID NO: 93440
  derived and/or modified sequence opt2 from hemagglutinin__InfluenzaA__ACF41669

SEQ ID NO: 93844 - RNA, 1698 nt, Artificial Sequence; identical to SEQ ID NO: 93426
  derived and/or modified sequence opt2 from hemagglutinin__InfluenzaA__ACF41680

SEQ ID NO: 93845 - RNA, 1689 nt, Artificial Sequence
  derived and/or modified sequence opt2 from hemagglutinin__InfluenzaA__ACF41691
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacgagaccgacggcggcuccaaggccugcgccgucuccggcaagcccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcagcgcgcccucuaccaggaggucggcaccuacgucuccgccuccaccuccacccucaacaagcgcuccacccccgagaucgccgcccgccccaaggucuccggccucggcucccgcauggaguucuccuggacccuccucgacgucugggacaccaucuccuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucgagcucuccuccaugggcgucuaccagauccucgccaucuacgccaccgucgccggcucccucucccucgccaucaugaucgccggcaucuccuucuggaugugcuccaacggcucccuccagugccgcaucugcaucuga

SEQ ID NO: 93846 - RNA, 1701 nt, Artificial Sequence; identical to SEQ ID NO: 93828
  derived and/or modified sequence opt2 from hemagglutinin__InfluenzaA__ACF41735

SEQ ID NO: 93847 - RNA, 1701 nt, Artificial Sequence
  derived and/or modified sequence opt2 from hemagglutinin__InfluenzaA__ACF41790
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgaggacuucaccuggaccggcgucacccagaacggcggcuccaacgccugcaagcgcggccccggcuccggcuucuucucccgccucaacuggcucaccaaguccggcuccaccuaccccguccucgacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93848 - RNA, 1701 nt, Artificial Sequence
  derived and/or modified sequence opt2 from hemagglutinin__InfluenzaA__ACF41823
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccgccagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93849 - RNA, 1698 nt, Artificial Sequence
  derived and/or modified sequence opt2 from hemagglutinin__InfluenzaA__ACF41834
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaaccucaagaacuccuacgucaacaagaagggcaaggagguccucguccucuggggcauccaccaccccuccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 93850 - RNA, 1701 nt, Artificial Sequence
  derived and/or modified sequence opt2 from hemagglutinin__InfluenzaA__ACF41856
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgaccagaccucccucuacguccgcgccuccggccgcgucaccgucuccaccaagcgcucccagcagaccgucacccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93851 - RNA, 1698 nt, Artificial Sequence
  derived and/or modified sequence opt2 from hemagglutinin__InfluenzaA__ACF41867
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucaccgccuccugcucccacaacggcaaguccuccuucuaccgcaaccuccucuggcucaccgagaagaacggccucuaccccaaccucuccaacuccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugaacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93852 - RNA, 1698 nt, Artificial Sequence; identical to SEQ ID NO: 93627
  derived and/or modified sequence opt2 from hemagglutinin__InfluenzaA__ACF41878

SEQ ID NO: 93853 - RNA, 1701 nt, Artificial Sequence
  derived and/or modified sequence opt2 from hemagglutinin__InfluenzaA__ACF41922
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccaagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacggccgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcggcaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93854 - RNA, 1689 nt, Artificial Sequence
  derived and/or modified sequence opt2 from hemagglutinin__InfluenzaA__ACF54389
auggccaucaucuaccucauccuccucuucgccaccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcucccucaacgacuacgaggagcucaagcaccuccucuccuccgucaagcacuucgagaagguccgcauccuccccaaggaccgcuggacccagcacaccaccaccggcggcuccaaggccugcgccgucuccggcaagcccuccuucuuccgcaacauggucuggcucaccaagaagggcaccaacuaccccgucgccaagggcuccuacaacaacaccuccggcgagcagaugcucaucaucuggggcguccaccaccccaucgacgaggccgagcagcgcgcccucuaccaggaggucggcaccuacgucuccgccuccaccuccacccucaacaagcgcuccauccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgagcagggcuccggcuacgccgccgacaaggaguccacccagaaggccuucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucauggucgccggcaucuccuucuggaugugcuccaacggcucccuccagugccgcaucugcaucuga

SEQ ID NO: 93855 - RNA, 1701 nt, Artificial Sequence; identical to SEQ ID NO: 93828
  derived and/or modified sequence opt2 from hemagglutinin__InfluenzaA__ACF54400

SEQ ID NO: 93856 - RNA, 1701 nt, Artificial Sequence; identical to SEQ ID NO: 93830
  derived and/or modified sequence opt2 from hemagglutinin__InfluenzaA__ACF54411

SEQ ID NO: 93857 - RNA, 1701 nt, Artificial Sequence; identical to SEQ ID NO: 93830
  derived and/or modified sequence opt2 from hemagglutinin__InfluenzaA__ACF54422

SEQ ID NO: 93858 - RNA, 1701 nt, Artificial Sequence; identical to SEQ ID NO: 93841
  derived and/or modified sequence opt2 from hemagglutinin__InfluenzaA__ACF54433

SEQ ID NO: 93859 - RNA, 1701 nt, Artificial Sequence; identical to SEQ ID NO: 93830
  derived and/or modified sequence opt2 from hemagglutinin__InfluenzaA__ACF54444

SEQ ID NO: 93860 - RNA, 1701 nt, Artificial Sequence; identical to SEQ ID NO: 93848
  derived and/or modified sequence opt2 from hemagglutinin__InfluenzaA__ACF54466

SEQ ID NO: 93861 - RNA, 1689 nt, Artificial Sequence
  derived and/or modified sequence opt2 from hemagglutinin__InfluenzaA__ACF54477
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93862 - RNA, 1689 nt, Artificial Sequence
  derived and/or modified sequence opt2 from hemagglutinin__InfluenzaA__ACF54499
auggccaucaucuaccucauccuccucuucaccgccguccgcggcgaccagaucugcaucggcuaccacgccaacaacuccaccgagaccgucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93863 - RNA, 1689 nt, Artificial Sequence; identical to SEQ ID NO: 93862
  derived and/or modified sequence opt2 from hemagglutinin__InfluenzaA__ACF54510

SEQ ID NO: 93864 - RNA, 1689 nt, Artificial Sequence; identical to SEQ ID NO: 93862
  derived and/or modified sequence opt2 from hemagglutinin__InfluenzaA__ACF54521

SEQ ID NO: 93865 - RNA, 1701 nt, Artificial Sequence
  derived and/or modified sequence opt2 from hemagglutinin__InfluenzaA__ACF54532
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaccuccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93866 - RNA, 1701 nt, Artificial Sequence
  derived and/or modified sequence opt2 from hemagglutinin__InfluenzaA__ACF54543
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggaccucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93867 - RNA, 1701 nt, Artificial Sequence
  derived and/or modified sequence opt2 from hemagglutinin__InfluenzaA__ACF54565
augaagaccaucaucgcccucuccuacauccucugccucgucuucucccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccgucaccgacuccgaccagaucucccucuacgcccaggccuccggccgcaucaccgucuccaccaagcgcucccagcagaccgucauccccaacaucggcuaccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93868 - RNA, 1701 nt, Artificial Sequence
  derived and/or modified sequence opt2 from hemagglutinin__InfluenzaA__ACF54576
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacuggaccggcgucacccagaacggcaccuccuccuccugcaagcgccgcuccaacaacuccuucuucucccgccucaacuggcucacccagcucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93869 - RNA, 1698 nt, Artificial Sequence
  derived and/or modified sequence opt2 from hemagglutinin__InfluenzaA__ACF54598
augaaggccaagcuccucguccuccucuacgccuucgucgccaccgacgccgacaccaucugcaucggcuaccacgccaacaacuccaccgacaccgucgacaccaucuucgagaagaacgucgccgucacccacuccgucaaccuccucgaggaccgccacaacggcaagcucugcaagcucaagggcaucgccccccuccagcucggcaagugcaacaucaucggcuggcuccucggcaaccccgagugcgacucccuccuccccgcccgcuccugguccuacaucgucgagacccccaacuccgagaacggcgccugcuaccccggcgacuucaucgacuacgaggagcuccgcgagcagcucuccuccgucuccucccucgagcgcuucgagaucuuccccaaggaguccuccuggcccaaccacaccuucaacggcgucaccgccuccugcucccaccgcggcaaguccuccuucuaccgcaaccuccucuggcucaccaagaagggcgacuccuaccccaagcucaccaacuccuacgucaacaacaagggcaaggagguccucguccucuggggcguccaccaccccuccuccuccgacgagcagcagucccucuacuccaacggcaacgccuacgucuccgucgccuccuccaacuacaaccgccgcuucacccccgagaucgccgcccgccccaaggucaaggaccagcacggccgcaugaacuacuacuggacccuccucgagcccggcgacaccaucaucuucgaggccaccggcaaccucaucgcccccugguacgccuucgcccucucccgcggcuucgaguccggcaucaucaccuccaacgccuccaugcacgagugcaacaccaagugccagaccccccagggcuccaucaacuccaaccuccccuuccagaacauccaccccgucaccaucggcgagugccccaaguacguccgcuccaccaagcuccgcauggucaccggccuccgcaacauccccuccauccaguaccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacggccgcacccucgacuuccacgaccucaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93870 - RNA, 1704 nt, Artificial Sequence
  derived and/or modified sequence opt2 from hemagglutinin__InfluenzaA__ACG50699
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacauggucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccucccucggcgucuccuccgccugccccuaccagggcuccuccuccuucuuccgcaacgucgucuggcucaucaagaagaacaacgccuaccccaccaucaagcgcuccuacaacaacaccaaccaggaggaccuccucguccucuggggcauccaccaccccaacgacgaggccgagcagacccgccucuaccagaaccccaccaccuacaucuccgucggcaccuccacccucaaccagcgccucauccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaugggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93871 - RNA, 1701 nt, Artificial Sequence; identical to SEQ ID NO: 93440
  derived and/or modified sequence opt2 from hemagglutinin__InfluenzaA__ACG70142

SEQ ID NO: 93872 - RNA, 1701 nt, Artificial Sequence; identical to SEQ ID NO: 93440
  derived and/or modified sequence opt2 from hemagglutinin__InfluenzaA__ACG70153

SEQ ID NO: 93873 - RNA, 1701 nt, Artificial Sequence
  derived and/or modified sequence opt2 from hemagglutinin__InfluenzaA__ACG80410
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93874 - RNA, 1701 nt, Artificial Sequence
  derived and/or modified sequence opt2 from hemagglutinin__InfluenzaA__ACG80420
augcagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93875 - RNA, 1701 nt, Artificial Sequence; identical to SEQ ID NO: 93873
  derived and/or modified sequence opt2 from hemagglutinin__InfluenzaA__ACG80426

SEQ ID NO: 93876 - RNA, 1701 nt, Artificial Sequence; identical to SEQ ID NO: 93873
  derived and/or modified sequence opt2 from hemagglutinin__InfluenzaA__ACG80430

SEQ ID NO: 93877 - RNA, 1701 nt, Artificial Sequence
  derived and/or modified sequence opt2 from hemagglutinin__InfluenzaA__ACG80436
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgcccucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93878 - RNA, 1701 nt, Artificial Sequence
  derived and/or modified sequence opt2 from hemagglutinin__InfluenzaA__ACG80445
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaaccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93879 - RNA, 1701 nt, Artificial Sequence; identical to SEQ ID NO: 93873
  derived and/or modified sequence opt2 from hemagglutinin__InfluenzaA__ACG80454

SEQ ID NO: 93880 - RNA, 1701 nt, Artificial Sequence; identical to SEQ ID NO: 93873
  derived and/or modified sequence opt2 from hemagglutinin__InfluenzaA__ACG80463

SEQ ID NO: 93881 - RNA, 1701 nt, Artificial Sequence
  derived and/or modified sequence opt2 from hemagglutinin__InfluenzaA__ACG80472
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgcccucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93882 - RNA, 1701 nt, Artificial Sequence
  derived and/or modified sequence opt2 from hemagglutinin__InfluenzaA__ACH69558
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccuccgcuucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93883 - RNA, 1701 nt, Artificial Sequence
  derived and/or modified sequence opt2 from hemagglutinin__InfluenzaA__ACH69569
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacucccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93884 - RNA, 1701 nt, Artificial Sequence
  derived and/or modified sequence opt2 from hemagglutinin__InfluenzaA__ACH69580
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93885 - RNA, 1701 nt, Artificial Sequence
  derived and/or modified sequence opt2 from hemagglutinin__InfluenzaA__ACH69591
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaacuccuucuucucccgccucaacuggcuccaccagcucaaguaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaacgaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93886 - RNA, 1701 nt, Artificial Sequence
  derived and/or modified sequence opt2 from hemagglutinin__InfluenzaA__ACH69602
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaacuccuucuucucccgccucaacuggcuccaccagcucaaguaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93887 - RNA, 1701 nt, Artificial Sequence
  derived and/or modified sequence opt2 from hemagglutinin__InfluenzaA__ACH69613
augaagaccaucaucgcccucuccuacauccucugccucgccuucgcccagaagcuccccggcaacgacaacuccacccccacccucugccucggccaccacgccguccccaacggcacccucgucaagaccaucaccaacgaccagaucgaggucaccaacgccaccgagcucguccaguccuccuccaccggcggcaucugcgacuccccccaccagaucaucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaacuccuucuucucccgccucaacuggcuccaccagcucaaguaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccccaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggccuccgccaccagaacuccgagggcaccggccaggccgccgaccucaaguccacccaggccgccaucaaccagaucaacggcaagcucaacaagcucaucgagaagaccaacgagaaguuccaccagaucgagaacgaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93888 - RNA, 1701 nt, Artificial Sequence; identical to SEQ ID NO: 92142
  derived and/or modified sequence opt2 from hemagglutinin__InfluenzaA__ACH82060

SEQ ID NO: 93889 - RNA, 1701 nt, Artificial Sequence; identical to SEQ ID NO: 93828
  derived and/or modified sequence opt2 from hemagglutinin__InfluenzaA__ACI06123

SEQ ID NO: 93890 - RNA, 1701 nt, Artificial Sequence; identical to SEQ ID NO: 93828
  derived and/or modified sequence opt2 from hemagglutinin__InfluenzaA__ACI06126

SEQ ID NO: 93891 - RNA, 1701 nt, Artificial Sequence; identical to SEQ ID NO: 93828
  derived and/or modified sequence opt2 from hemagglutinin__InfluenzaA__ACI06127

SEQ ID NO: 93892 - RNA, 1701 nt, Artificial Sequence; identical to SEQ ID NO: 93828
  derived and/or modified sequence opt2 from hemagglutinin__InfluenzaA__ACI06129

SEQ ID NO: 93893 - RNA, 1701 nt, Artificial Sequence; identical to SEQ ID NO: 93828
  derived and/or modified sequence opt2 from hemagglutinin__InfluenzaA__ACI06130

SEQ ID NO: 93894 - RNA, 1701 nt, Artificial Sequence; identical to SEQ ID NO: 93828
  derived and/or modified sequence opt2 from hemagglutinin__InfluenzaA__ACI06132

SEQ ID NO: 93895 - RNA, 1701 nt, Artificial Sequence; identical to SEQ ID NO: 93830
  derived and/or modified sequence opt2 from hemagglutinin__InfluenzaA__ACI06133

SEQ ID NO: 93896 - RNA, 1701 nt, Artificial Sequence; identical to SEQ ID NO: 93830
  derived and/or modified sequence opt2 from hemagglutinin__InfluenzaA__ACI06134

SEQ ID NO: 93897 - RNA, 1701 nt, Artificial Sequence; identical to SEQ ID NO: 93830
  derived and/or modified sequence opt2 from hemagglutinin__InfluenzaA__ACI06135

SEQ ID NO: 93898 - RNA, 1701 nt, Artificial Sequence; identical to SEQ ID NO: 93830
  derived and/or modified sequence opt2 from hemagglutinin__InfluenzaA__ACI06136

SEQ ID NO: 93899 - RNA, 1701 nt, Artificial Sequence; identical to SEQ ID NO: 93830
  derived and/or modified sequence opt2 from hemagglutinin__InfluenzaA__ACI06137

SEQ ID NO: 93900 - RNA, 1701 nt, Artificial Sequence; identical to SEQ ID NO: 93830
  derived and/or modified sequence opt2 from hemagglutinin__InfluenzaA__ACI06138

SEQ ID NO: 93901 - RNA, 1701 nt, Artificial Sequence; identical to SEQ ID NO: 93830
  derived and/or modified sequence opt2 from hemagglutinin__InfluenzaA__ACI06139

SEQ ID NO: 93902 - RNA, 1701 nt, Artificial Sequence; identical to SEQ ID NO: 93830
  derived and/or modified sequence opt2 from hemagglutinin__InfluenzaA__ACI06140

SEQ ID NO: 93903 - RNA, 1701 nt, Artificial Sequence; identical to SEQ ID NO: 93830
  derived and/or modified sequence opt2 from hemagglutinin__InfluenzaA__ACI06141

SEQ ID NO: 93904 - RNA, 1701 nt, Artificial Sequence; identical to SEQ ID NO: 93830
  derived and/or modified sequence opt2 from hemagglutinin__InfluenzaA__ACI06142

SEQ ID NO: 93905 - RNA, 1701 nt, Artificial Sequence; identical to SEQ ID NO: 93830
  derived and/or modified sequence opt2 from hemagglutinin__InfluenzaA__ACI06143

SEQ ID NO: 93906 - RNA, 1701 nt, Artificial Sequence
  derived and/or modified sequence opt2 from hemagglutinin__InfluenzaA__ACI06144
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaaccgccucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93907 - RNA, 1701 nt, Artificial Sequence; identical to SEQ ID NO: 93830
  derived and/or modified sequence opt2 from hemagglutinin__InfluenzaA__ACI06145

SEQ ID NO: 93908 - RNA, 1701 nt, Artificial Sequence
  derived and/or modified sequence opt2 from hemagglutinin__InfluenzaA__ACI06146
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcuccucccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuacgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93909 - RNA, 1701 nt, Artificial Sequence; identical to SEQ ID NO: 93830
  derived and/or modified sequence opt2 from hemagglutinin__InfluenzaA__ACI06147

SEQ ID NO: 93910 - RNA, 1701 nt, Artificial Sequence; identical to SEQ ID NO: 93830
  derived and/or modified sequence opt2 from hemagglutinin__InfluenzaA__ACI06148

SEQ ID NO: 93911 - RNA, 1701 nt, Artificial Sequence
  derived and/or modified sequence opt2 from hemagglutinin__InfluenzaA__ACI06149
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccgccagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93912 - RNA, 1701 nt, Artificial Sequence; identical to SEQ ID NO: 93841
  derived and/or modified sequence opt2 from hemagglutinin__InfluenzaA__ACI06151

SEQ ID NO: 93913 - RNA, 1701 nt, Artificial Sequence; identical to SEQ ID NO: 93841
  derived and/or modified sequence opt2 from hemagglutinin__InfluenzaA__ACI06152

SEQ ID NO: 93914 - RNA, 1701 nt, Artificial Sequence
  derived and/or modified sequence opt2 from hemagglutinin__InfluenzaA__ACI06153
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacgagcucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93915 - RNA, 1701 nt, Artificial Sequence
  derived and/or modified sequence opt2 from hemagglutinin__InfluenzaA__ACI06155
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucguccgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93916 - RNA, 1701 nt, Artificial Sequence; identical to SEQ ID NO: 93841
  derived and/or modified sequence opt2 from hemagglutinin__InfluenzaA__ACI06156

SEQ ID NO: 93917 - RNA, 1701 nt, Artificial Sequence; identical to SEQ ID NO: 93841
  derived and/or modified sequence opt2 from hemagglutinin__InfluenzaA__ACI06157

SEQ ID NO: 93918 - RNA, 1701 nt, Artificial Sequence; identical to SEQ ID NO: 93841
  derived and/or modified sequence opt2 from hemagglutinin__InfluenzaA__ACI06158

SEQ ID NO: 93919 - RNA, 1701 nt, Artificial Sequence; identical to SEQ ID NO: 93841
  derived and/or modified sequence opt2 from hemagglutinin__InfluenzaA__ACI06159

SEQ ID NO: 93920 - RNA, 1701 nt, Artificial Sequence; identical to SEQ ID NO: 93830
  derived and/or modified sequence opt2 from hemagglutinin__InfluenzaA__ACI06160

SEQ ID NO: 93921 - RNA, 1701 nt, Artificial Sequence
  derived and/or modified sequence opt2 from hemagglutinin__InfluenzaA__ACI06161
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaagggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93922 - RNA, 1701 nt, Artificial Sequence
  derived and/or modified sequence opt2 from hemagglutinin__InfluenzaA__ACI06162
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaaccccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93923 - RNA, 1701 nt, Artificial Sequence
  derived and/or modified sequence opt2 from hemagglutinin__InfluenzaA__ACI06163
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaagggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93924 - RNA, 1701 nt, Artificial Sequence
  derived and/or modified sequence opt2 from hemagglutinin__InfluenzaA__ACI06164
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucaacaucuacuggaccaucgucaagcccggcgacguccucgucaucaacuccaacggcaaccucaucgccccccgcggcuacuucaagaugcgcaacggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93925 - RNA, 1701 nt, Artificial Sequence
  derived and/or modified sequence opt2 from hemagglutinin__InfluenzaA__ACI06165
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaacggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93926 - RNA, 1701 nt, Artificial Sequence
  derived and/or modified sequence opt2 from hemagglutinin__InfluenzaA__ACI06166
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggauccgcggccucuccucccgcaucaacaucuacuggaccaucgucaagcccggcgacguccucgucaucaacuccaacggcaaccucaucgccccccgcggcuacuucaagaugcgcaacggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93927 - RNA, 1701 nt, Artificial Sequence; identical to SEQ ID NO: 93911
  derived and/or modified sequence opt2 from hemagglutinin__InfluenzaA__ACI06167

SEQ ID NO: 93928 - RNA, 1701 nt, Artificial Sequence
  derived and/or modified sequence opt2 from hemagglutinin__InfluenzaA__ACI06168
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93929 - RNA, 1701 nt, Artificial Sequence; identical to SEQ ID NO: 93830
  derived and/or modified sequence opt2 from hemagglutinin__InfluenzaA__ACI06169

SEQ ID NO: 93930 - RNA, 1701 nt, Artificial Sequence; identical to SEQ ID NO: 93847
  derived and/or modified sequence opt2 from hemagglutinin__InfluenzaA__ACI06171

SEQ ID NO: 93931 - RNA, 1701 nt, Artificial Sequence; identical to SEQ ID NO: 93847
  derived and/or modified sequence opt2 from hemagglutinin__InfluenzaA__ACI06172

SEQ ID NO: 93932 - RNA, 1701 nt, Artificial Sequence
  derived and/or modified sequence opt2 from hemagglutinin__InfluenzaA__ACI06173
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgagaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93933 - RNA, 1701 nt, Artificial Sequence; identical to SEQ ID NO: 93847
  derived and/or modified sequence opt2 from hemagglutinin__InfluenzaA__ACI06174

SEQ ID NO: 93934 - RNA, 1701 nt, Artificial Sequence; identical to SEQ ID NO: 93848
  derived and/or modified sequence opt2 from hemagglutinin__InfluenzaA__ACI06175

SEQ ID NO: 93935 - RNA, 1701 nt, Artificial Sequence; identical to SEQ ID NO: 93848
  derived and/or modified sequence opt2 from hemagglutinin__InfluenzaA__ACI06176

SEQ ID NO: 93936 - RNA, 1701 nt, Artificial Sequence; identical to SEQ ID NO: 93848
  derived and/or modified sequence opt2 from hemagglutinin__InfluenzaA__ACI06177

SEQ ID NO: 93937 - RNA, 1689 nt, Artificial Sequence
  derived and/or modified sequence opt2 from hemagglutinin__InfluenzaA__ACI25724
auggccaucaucuaccucauccuccucuucgccaccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagcgcgagaacccccgcuacucccucugcuaccccggcucccucaacgacuacgaggagcucaagcaccuccucuccuccgucaagcacuucgagaagguccgcauccuccccaaggaccgcuggacccagcacaccaccaccggcggcuccaaggccugcgccgucuccggcaagcccuccuucuuccgcaacauggucuggcucaccaagaagggccccaacuaccccgucgccaagggcuccuacaacaacaccuccggcgagcagaugcucaucaucuggggcguccaccaccccaaggacgaggccgagcagcgcgcccucuaccaggaggucggcaccuacgucuccgccuccaccuccacccucaacaagcgcuccauccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucauggucgccggcaucuccuucuggaugugcuccaacggcucccuccagugccgcaucugcaucuga

SEQ ID NO: 93938 - RNA, 1701 nt, Artificial Sequence
  derived and/or modified sequence opt2 from hemagglutinin__InfluenzaA__ACI25746
augaagaccaucaucgcccucuccuacaucuucugccucgcccucggccaguaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucgacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93939 - RNA, 1701 nt, Artificial Sequence
  derived and/or modified sequence opt2 from hemagglutinin__InfluenzaA__ACI25757
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccucguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93940 - RNA, 1701 nt, Artificial Sequence; identical to SEQ ID NO: 93828
  derived and/or modified sequence opt2 from hemagglutinin__InfluenzaA__ACI25768

SEQ ID NO: 93941 - RNA, 1701 nt, Artificial Sequence
  derived and/or modified sequence opt2 from hemagglutinin__InfluenzaA__ACI25779
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucuggucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93942 - RNA, 1701 nt, Artificial Sequence
  derived and/or modified sequence opt2 from hemagglutinin__InfluenzaA__ACI25790
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucuggucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcuccggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93943 - RNA, 1701 nt, Artificial Sequence
  derived and/or modified sequence opt2 from hemagglutinin__InfluenzaA__ACI25801
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgaggacuucaccuggaccggcgucacccagaacggcggcuccaacgccugcaagcgcggccccggcuccggcuucuucucccgccucaacuggcucaccaaguccggcuccaccuaccccguccucgacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93944 - RNA, 1689 nt, Artificial Sequence; identical to SEQ ID NO: 93862
  derived and/or modified sequence opt2 from hemagglutinin__InfluenzaA__ACI26274

SEQ ID NO: 93945 - RNA, 1698 nt, Artificial Sequence
  derived and/or modified sequence opt2 from hemagglutinin__InfluenzaA__ACI26307
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagaucuuccucuacgcccaguccggccgcaucaccgucuccaccaagcgcucccagcagaccgucauccccaacaucggcucccgcccccgcguccgcaacucccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93946 - RNA, 1701 nt, Artificial Sequence
  derived and/or modified sequence opt2 from hemagglutinin__InfluenzaA__ACI26362
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93947 - RNA, 1701 nt, Artificial Sequence
  derived and/or modified sequence opt2 from hemagglutinin__InfluenzaA__ACI26373
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93948 - RNA, 1701 nt, Artificial Sequence; identical to SEQ ID NO: 93813
  derived and/or modified sequence opt2 from hemagglutinin__InfluenzaA__ACI26395

SEQ ID NO: 93949 - RNA, 1701 nt, Artificial Sequence
  derived and/or modified sequence opt2 from hemagglutinin__InfluenzaA__ACI26406
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaagcaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93950 - RNA, 1701 nt, Artificial Sequence; identical to SEQ ID NO: 93440
  derived and/or modified sequence opt2 from hemagglutinin__InfluenzaA__ACI26417

SEQ ID NO: 93951 - RNA, 1701 nt, Artificial Sequence
  derived and/or modified sequence opt2 from hemagglutinin__InfluenzaA__ACI26428
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagauccgccucuacgcccaggccuccggccgcaucaccgucuccaccaagcgcucccagcagaccgucauccccaacaucggcuaccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93952 - RNA, 1698 nt, Artificial Sequence
  derived and/or modified sequence opt2 from hemagglutinin__InfluenzaA__ACI26439
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93953 - RNA, 1698 nt, Artificial Sequence; identical to SEQ ID NO: 93952
  derived and/or modified sequence opt2 from hemagglutinin__InfluenzaA__ACI26450

SEQ ID NO: 93954 - RNA, 1701 nt, Artificial Sequence
  derived and/or modified sequence opt2 from hemagglutinin__InfluenzaA__ACI26461
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93955 - RNA, 1698 nt, Artificial Sequence
  derived and/or modified sequence opt2 from hemagglutinin__InfluenzaA__ACI26472
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagaucuuccucuacgcccaguccggccgcaucaccgucuccaccaagcgcucccagcagaccgucauccccaacaucggcuaccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93956 - RNA, 1701 nt, Artificial Sequence; identical to SEQ ID NO: 93947
  derived and/or modified sequence opt2 from hemagglutinin__InfluenzaA__ACI26483

SEQ ID NO: 93957 - RNA, 1701 nt, Artificial Sequence
  derived and/or modified sequence opt2 from hemagglutinin__InfluenzaA__ACI26505
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcauccgcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93958 - RNA, 1701 nt, Artificial Sequence; identical to SEQ ID NO: 93946
  derived and/or modified sequence opt2 from hemagglutinin__InfluenzaA__ACI26516

SEQ ID NO: 93959 - RNA, 1701 nt, Artificial Sequence; identical to SEQ ID NO: 93947
  derived and/or modified sequence opt2 from hemagglutinin__InfluenzaA__ACI26527

SEQ ID NO: 93960 - RNA, 1701 nt, Artificial Sequence
  derived and/or modified sequence opt2 from hemagglutinin__InfluenzaA__ACI26538
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgacaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93961 - RNA, 1701 nt, Artificial Sequence
  derived and/or modified sequence opt2 from hemagglutinin__InfluenzaA__ACI26549
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacuccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaagcucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgaggaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93962 - RNA, 1701 nt, Artificial Sequence
  derived and/or modified sequence opt2 from hemagglutinin__InfluenzaA__ACI26560
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccaucaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93963 - RNA, 1701 nt, Artificial Sequence
  derived and/or modified sequence opt2 from hemagglutinin__InfluenzaA__ACI26571
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaagcucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93964 - RNA, 1701 nt, Artificial Sequence
  derived and/or modified sequence opt2 from hemagglutinin__InfluenzaA__ACI26593
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacaaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93965 - RNA, 1698 nt, Artificial Sequence
  derived and/or modified sequence opt2 from hemagglutinin__InfluenzaA__ACI32715
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacaccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93966 - RNA, 1698 nt, Artificial Sequence
  derived and/or modified sequence opt2 from hemagglutinin__InfluenzaA__ACI32716
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaccaucugcaucuga

SEQ ID NO: 93967 - RNA, 1698 nt, Artificial Sequence
  derived and/or modified sequence opt2 from hemagglutinin__InfluenzaA__ACI32717
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaugaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucaacuucuggaugugcuccaacggcucccuccagugcaagaucugcaucuga

SEQ ID NO: 93968 - RNA, 1698 nt, Artificial Sequence
  derived and/or modified sequence opt2 from hemagglutinin__InfluenzaA__ACI32718
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggaggucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaccaucugcaucuga

SEQ ID NO: 93969 - RNA, 1698 nt, Artificial Sequence; identical to SEQ ID NO: 93966
  derived and/or modified sequence opt2 from hemagglutinin__InfluenzaA__ACI32719

SEQ ID NO: 93970 - RNA, 1698 nt, Artificial Sequence; identical to SEQ ID NO: 93966
  derived and/or modified sequence opt2 from hemagglutinin__InfluenzaA__ACI32720

SEQ ID NO: 93971 - RNA, 1698 nt, Artificial Sequence
  derived and/or modified sequence opt2 from hemagglutinin__InfluenzaA__ACI32721
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucuccuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93972 - RNA, 1698 nt, Artificial Sequence; identical to SEQ ID NO: 93966
  derived and/or modified sequence opt2 from hemagglutinin__InfluenzaA__ACI32722

SEQ ID NO: 93973 - RNA, 1698 nt, Artificial Sequence
  derived and/or modified sequence opt2 from hemagglutinin__InfluenzaA__ACI32723
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcuucuga

SEQ ID NO: 93974 - RNA, 1698 nt, Artificial Sequence
  derived and/or modified sequence opt2 from hemagglutinin__InfluenzaA__ACI32724
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucaagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaagaucugcaucuga

SEQ ID NO: 93975 - RNA, 1698 nt, Artificial Sequence; identical to SEQ ID NO: 92897
  derived and/or modified sequence opt2 from hemagglutinin__InfluenzaA__ACI32725

SEQ ID NO: 93976 - RNA, 1698 nt, Artificial Sequence
  derived and/or modified sequence opt2 from hemagglutinin__InfluenzaA__ACI32726
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcaucuaccagauccucgccaucuacuccaccgucaccuccucccucguccuccucgucucccucggcgccaucuccuucuggaugugcuccaacggcucccuccagugccgcaucugcaucuga

SEQ ID NO: 93977 - RNA, 1698 nt, Artificial Sequence
  derived and/or modified sequence opt2 from hemagglutinin__InfluenzaA__ACI32727
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccaucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucacccucggcgccaucuccuucuggaugugcuccaacggcucccuccagugcaccaucugcaucuga

SEQ ID NO: 93978 - RNA, 1698 nt, Artificial Sequence
  derived and/or modified sequence opt2 from hemagglutinin__InfluenzaA__ACI32729
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucauccccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcgucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93979 - RNA, 1698 nt, Artificial Sequence; identical to SEQ ID NO: 93978
  derived and/or modified sequence opt2 from hemagglutinin__InfluenzaA__ACI32730

SEQ ID NO: 93980 - RNA, 1698 nt, Artificial Sequence
  derived and/or modified sequence opt2 from hemagglutinin__InfluenzaA__ACI32731
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucaaccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaagaucugcaucuga

SEQ ID NO: 93981 - RNA, 1698 nt, Artificial Sequence
  derived and/or modified sequence opt2 from hemagglutinin__InfluenzaA__ACI32732
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaccaucugcaucuga

SEQ ID NO: 93982 - RNA, 1698 nt, Artificial Sequence
  derived and/or modified sequence opt2 from hemagglutinin__InfluenzaA__ACI32733
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucaacuccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaccaucugcaucuga

SEQ ID NO: 93983 - RNA, 1698 nt, Artificial Sequence
  derived and/or modified sequence opt2 from hemagglutinin__InfluenzaA__ACI32734
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaagaagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaccaucugcaucuga

SEQ ID NO: 93984 - RNA, 1698 nt, Artificial Sequence
  derived and/or modified sequence opt2 from hemagglutinin__InfluenzaA__ACI32736
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacguccgcaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93985 - RNA, 1698 nt, Artificial Sequence
  derived and/or modified sequence opt2 from hemagglutinin__InfluenzaA__ACI32737
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucauccccaaggaguccugguccuacaucgucgagauccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggccucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcuccgcaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93986 - RNA, 1698 nt, Artificial Sequence
  derived and/or modified sequence opt2 from hemagglutinin__InfluenzaA__ACI32739
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcaaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaagaucugcaucuga

SEQ ID NO: 93987 - RNA, 1698 nt, Artificial Sequence
  derived and/or modified sequence opt2 from hemagglutinin__InfluenzaA__ACI32740
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaagcacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugccccaacggcucccuccagugcaccaucugcaucuga

SEQ ID NO: 93988 - RNA, 1698 nt, Artificial Sequence
  derived and/or modified sequence opt2 from hemagglutinin__InfluenzaA__ACI32741
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaagcacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugccccaacggcucccuccagugcaagaucugcaucuga

SEQ ID NO: 93989 - RNA, 1698 nt, Artificial Sequence
  derived and/or modified sequence opt2 from hemagglutinin__InfluenzaA__ACI32742
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugcaagaucugcaucuga

SEQ ID NO: 93990 - RNA, 1698 nt, Artificial Sequence
  derived and/or modified sequence opt2 from hemagglutinin__InfluenzaA__ACI32743
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaagaaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcaaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93991 - RNA, 1701 nt, Artificial Sequence
  derived and/or modified sequence opt2 from hemagglutinin__InfluenzaA__ACJ09818
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccaggucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 93992 - RNA, 1683 nt, Artificial Sequence
  derived and/or modified sequence opt2 from hemagglutinin__InfluenzaA__ACJ67533
auggagaccaucucccucaucaccauccuccucgucgucaccgccuccaacgccgacaagaucugcaucggccaccaguccaccaacuccaccgagaccgucgacacccucaccgagaccaacguccccgucacccacgccaaggagcuccuccacaccgagcacaacggcaugcucugcgccaccucccucggccacccccucauccucgacaccugcaccaucgagggccucgucuacggcaaccccuccugcgaccuccuccucgagggccgcgagugguccuacaucgucgagcgcuccuccgccgucaacggcaccugcuaccccggcaacgucgagaaccucgaggagcuccgcacccucuucuccuccgccuccuccuaccagcgcauccagaucuuccccgacaccaccuggaacgucaccuacaccggcaccucccgcgccugcuccggcuccuucuaccgcuccaugcgcuggcucacccagaaguccggcuucuaccccguccaggacgcccaguacaccaacaaccgcggcaaguccauccucuucgucuggggcauccaccacccccccaccuacgccgagcagaccaaccucuacauccgcaacgacaccaccaccuccgucaccaccgaggaccucaaccgcaccuucaagcccgucaucggcccccgcccccucgucaacggccuccagggccgcaucgacuacuacugguccguccucaagcccggccagacccuccgcguccgcuccaacggcaaccucaucgcccccugguacggccacguccucuccggcggcucccacggccgcauccucaagaccgaccucaaguccggcuccugcgucguccagugccagaccgagaagggcggccucaacuccacccuccccuuccacaacaucuccaaguacgccuucggcaccugccccaaguacguccgcgucaacucccucaagcucgccgucggccuccgcaacguccccgcccgcuccucccgcggccucuucggcgccaucgccggcuucaucgagggcggcuggcccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacgucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcgccagaagaucgagggcgucaagcucgaguccgagcgcaccuacaagauccucaccaucuacuccaccgucgccuccucccucguccucgccaugggcuucgccgccuuccucuucugggccauguccaacggcuccugccgcugcaacaucugcaucuga

SEQ ID NO: 93993 - RNA, 1704 nt, Artificial Sequence
  derived and/or modified sequence opt2 from hemagglutinin__InfluenzaA__ACJ68607
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucggcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93994 - RNA, 1704 nt, Artificial Sequence
  derived and/or modified sequence opt2 from hemagglutinin__InfluenzaA__ACJ68609
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccuccgccgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93995 - RNA, 1704 nt, Artificial Sequence
  derived and/or modified sequence opt2 from hemagglutinin__InfluenzaA__ACJ68610
auggagaagaucguccucuuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93996 - RNA, 1704 nt, Artificial Sequence
  derived and/or modified sequence opt2 from hemagglutinin__InfluenzaA__ACJ68611
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccucccucggcgucuccuccgccugccccuaccagggcaugcccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucggcuacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacgacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93997 - RNA, 1704 nt, Artificial Sequence
  derived and/or modified sequence opt2 from hemagglutinin__InfluenzaA__ACJ68612
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccuggcccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacaacgccgccgagcagaccaagcucuaccagaaccccaccaccuacaucuccgucggcaccuccacccucaaccuccgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcgccuaccagauccucuccaucuacuccaccgucgccuccucccucgcccucgccaucauggucgccggccucucccucuggaugugcuccaacggcucccuccagugccgcaucugcaucuga

SEQ ID NO: 93998 - RNA, 1704 nt, Artificial Sequence
  derived and/or modified sequence opt2 from hemagglutinin__InfluenzaA__ACJ68613
auggagaagaucguccucuuccucgccaucgucucccacgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucggcggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgucugccccuaccagggcacccccuccuucuuccgcaacgucgucuggcucaucaagaagaacaacaccuaccccaccaucaagaaguccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 93999 - RNA, 1707 nt, Artificial Sequence
  derived and/or modified sequence opt2 from hemagglutinin__InfluenzaA__ACJ68614
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgucaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacaacaccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagcucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcgcggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 94000 - RNA, 1698 nt, Artificial Sequence
  derived and/or modified sequence opt2 from hemagglutinin__InfluenzaA__ACK99007
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94001 - RNA, 1698 nt, Artificial Sequence
  derived and/or modified sequence opt2 from hemagglutinin__InfluenzaA__ACK99008
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucguccuccucgucucccucggcgccaucuccuucuggaugugcuccaacggcucccuccagugccgcaucugcaucuga

SEQ ID NO: 94002 - RNA, 1698 nt, Artificial Sequence
  derived and/or modified sequence opt2 from hemagglutinin__InfluenzaA__ACK99009
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaccuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94003 - RNA, 1698 nt, Artificial Sequence; identical to SEQ ID NO: 94000
  derived and/or modified sequence opt2 from hemagglutinin__InfluenzaA__ACK99011

SEQ ID NO: 94004 - RNA, 1698 nt, Artificial Sequence
  derived and/or modified sequence opt2 from hemagglutinin__InfluenzaA__ACK99012
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucaucucccucggcgccaucuccuucuggaugugcuccaacggcucccuccagugccgcaucugcaucuga

SEQ ID NO: 94005 - RNA, 1698 nt, Artificial Sequence; identical to SEQ ID NO: 94000
  derived and/or modified sequence opt2 from hemagglutinin__InfluenzaA__ACK99013

SEQ ID NO: 94006 - RNA, 1698 nt, Artificial Sequence
  derived and/or modified sequence opt2 from hemagglutinin__InfluenzaA__ACK99014
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucacccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94007 - RNA, 1698 nt, Artificial Sequence; identical to SEQ ID NO: 94000
  derived and/or modified sequence opt2 from hemagglutinin__InfluenzaA__ACK99016

SEQ ID NO: 94008 - RNA, 1698 nt, Artificial Sequence; identical to SEQ ID NO: 94000
  derived and/or modified sequence opt2 from hemagglutinin__InfluenzaA__ACK99018

SEQ ID NO: 94009 - RNA, 1698 nt, Artificial Sequence; identical to SEQ ID NO: 94000
  derived and/or modified sequence opt2 from hemagglutinin__InfluenzaA__ACK99023

SEQ ID NO: 94010 - RNA, 1698 nt, Artificial Sequence
  derived and/or modified sequence opt2 from hemagglutinin__InfluenzaA__ACK99026
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccaucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94011 - RNA, 1698 nt, Artificial Sequence; identical to SEQ ID NO: 93684
  derived and/or modified sequence opt2 from hemagglutinin__InfluenzaA__ACK99027

SEQ ID NO: 94012 - RNA, 1698 nt, Artificial Sequence
  derived and/or modified sequence opt2 from hemagglutinin__InfluenzaA__ACK99028
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagacccccaagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94013 - RNA, 1698 nt, Artificial Sequence
  derived and/or modified sequence opt2 from hemagglutinin__InfluenzaA__ACK99029
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucuccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94014 - RNA, 1698 nt, Artificial Sequence; identical to SEQ ID NO: 94000
  derived and/or modified sequence opt2 from hemagglutinin__InfluenzaA__ACK99030

SEQ ID NO: 94015 - RNA, 1698 nt, Artificial Sequence; identical to SEQ ID NO: 94000
  derived and/or modified sequence opt2 from hemagglutinin__InfluenzaA__ACK99031

SEQ ID NO: 94016 - RNA, 1698 nt, Artificial Sequence; identical to SEQ ID NO: 94000
  derived and/or modified sequence opt2 from hemagglutinin__InfluenzaA__ACK99032

SEQ ID NO: 94017 - RNA, 1698 nt, Artificial Sequence; identical to SEQ ID NO: 94000
  derived and/or modified sequence opt2 from hemagglutinin__InfluenzaA__ACK99033

SEQ ID NO: 94018 - RNA, 1698 nt, Artificial Sequence
  derived and/or modified sequence opt2 from hemagglutinin__InfluenzaA__ACK99034
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcgacuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94019 - RNA, 1698 nt, Artificial Sequence
  derived and/or modified sequence opt2 from hemagglutinin__InfluenzaA__ACK99035
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccgccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucuccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacacccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94020 - RNA, 1701 nt, Artificial Sequence; identical to SEQ ID NO: 93850
  derived and/or modified sequence opt2 from hemagglutinin__InfluenzaA__ACK99421

SEQ ID NO: 94021 - RNA, 1689 nt, Artificial Sequence
  derived and/or modified sequence opt2 from hemagglutinin__InfluenzaA__ACK99432
auggccaucaucuaccucauccuccucuucaccgccguccgcggcgaccagaucugcaucggcuaccacgccaacaacuccaccgagaagaucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggaccgcuggacccagcacaccaccaccggcggcuccauggccugcgccgucuccggcaagcccuccuucuuccgcaacauggucuggcucaccaccaagggccccaacuaccccgucgcccagggcuccuacaacaacaccuccggcgagcagaugcucaucaucuggggcguccaccaccccaacgacgaggccgagcagcgcgcccucuaccagaaggucggcaccuacgucuccgccuccaccuccacccucuacaagcgcuccauccccgagaucgccgcccgccccaaggucaacggccucggcucccgcauggaguucuccuggacccuccucgacaugugggacaccaucaacuucgaguccaccggcaaccucgucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacaacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94022 - RNA, 1701 nt, Artificial Sequence
  derived and/or modified sequence opt2 from hemagglutinin__InfluenzaA__ACK99443
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaaggaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccgccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccguccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94023 - RNA, 1701 nt, Artificial Sequence
  derived and/or modified sequence opt2 from hemagglutinin__InfluenzaA__ACK99465
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccaagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94024 - RNA, 1701 nt, Artificial Sequence
  derived and/or modified sequence opt2 from hemagglutinin__InfluenzaA__ACK99476
augaagaccaucaucgcccucuccuacauccucugcauggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccacccccgcaccgacuccgaccagaccucccucuacguccaggccuccggccgcgucaccgucuccaccaagcgcucccagcagaccgucauccccaacaucggcuccucccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94025 - RNA, 1698 nt, Artificial Sequence; identical to SEQ ID NO: 93426
  derived and/or modified sequence opt2 from hemagglutinin__InfluenzaA__ACL12063

SEQ ID NO: 94026 - RNA, 1701 nt, Artificial Sequence
  derived and/or modified sequence opt2 from hemagglutinin__InfluenzaA__ACL12129
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcggcuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccaguccucccgcaucuccaucuacuggaccaucgucaagcccggcgacauccuccucaucgacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccagcagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94027 - RNA, 1701 nt, Artificial Sequence; identical to SEQ ID NO: 93868
  derived and/or modified sequence opt2 from hemagglutinin__InfluenzaA__ACL12140

SEQ ID NO: 94028 - RNA, 1698 nt, Artificial Sequence; identical to SEQ ID NO: 93952
  derived and/or modified sequence opt2 from hemagglutinin__InfluenzaA__ACL12151

SEQ ID NO: 94029 - RNA, 1701 nt, Artificial Sequence; identical to SEQ ID NO: 93946
  derived and/or modified sequence opt2 from hemagglutinin__InfluenzaA__ACL12162

SEQ ID NO: 94030 - RNA, 1701 nt, Artificial Sequence
  derived and/or modified sequence opt2 from hemagglutinin__InfluenzaA__ACL12173
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94031 - RNA, 1701 nt, Artificial Sequence
  derived and/or modified sequence opt2 from hemagglutinin__InfluenzaA__ACL12184
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94032 - RNA, 1701 nt, Artificial Sequence; identical to SEQ ID NO: 93946
  derived and/or modified sequence opt2 from hemagglutinin__InfluenzaA__ACL12195

SEQ ID NO: 94033 - RNA, 1701 nt, Artificial Sequence
  derived and/or modified sequence opt2 from hemagglutinin__InfluenzaA__ACL12217
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacguccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94034 - RNA, 1701 nt, Artificial Sequence; identical to SEQ ID NO: 93946
  derived and/or modified sequence opt2 from hemagglutinin__InfluenzaA__ACL12228

SEQ ID NO: 94035 - RNA, 1701 nt, Artificial Sequence; identical to SEQ ID NO: 93946
  derived and/or modified sequence opt2 from hemagglutinin__InfluenzaA__ACL12239

SEQ ID NO: 94036 - RNA, 1701 nt, Artificial Sequence
  derived and/or modified sequence opt2 from hemagglutinin__InfluenzaA__ACL12250
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94037 - RNA, 1701 nt, Artificial Sequence
  derived and/or modified sequence opt2 from hemagglutinin__InfluenzaA__ACL12261
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccgccugcucccacaagggccgcuccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94038 - RNA, 1689 nt, Artificial Sequence
  derived and/or modified sequence opt2 from hemagglutinin__InfluenzaA__ACN32272
auggccaucaucuaccucauccuccucuucaccgccguccgcggcgaccagaucugcaucggcuaccacgccaacaacuccaccgagaagaucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggaccgcuggacccagcacaccaccaccggcggcuccauggccugcgccgucuccggcaagcccuccuucuuccgcaacauggucuggcucaccaccaagggccccaacuaccccgucgcccagggcuccuacaacaacaccuccggcgagcagaugcucaucaucuggggcguccaccaccccaacgacgaggccgagcagcgcgcccucuaccagaacgucggcaccuacgucuccgccuccaccuccacccucuacaagcgcuccauccccgagaucgccgcccgccccaaggucaacggccucggcucccgcauggaguucuccuggacccuccucgacaugugggacaccaucaacuucgaguccaccggcaaccucgucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacaacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94039 - RNA, 1701 nt, Artificial Sequence
  derived and/or modified sequence opt2 from hemagglutinin__InfluenzaA__ACN32283
augaagaccaucaucgcccucuccuacauccucugccucgucuccgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94040 - RNA, 1701 nt, Artificial Sequence
  derived and/or modified sequence opt2 from hemagglutinin__InfluenzaA__ACN32474
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacaccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacaugaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgaggucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94041 - RNA, 1698 nt, Artificial Sequence; identical to SEQ ID NO: 94000
  derived and/or modified sequence opt2 from hemagglutinin__InfluenzaA__ACN32501

SEQ ID NO: 94042 - RNA, 1701 nt, Artificial Sequence
  derived and/or modified sequence opt2 from hemagglutinin__InfluenzaA__ACN32534
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 94043 - RNA, 1701 nt, Artificial Sequence
  derived and/or modified sequence opt2 from hemagglutinin__InfluenzaA__ACN32545
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94044 - RNA, 1698 nt, Artificial Sequence
  derived and/or modified sequence opt2 from hemagglutinin__InfluenzaA__ACN32793
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccgaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94045 - RNA, 1698 nt, Artificial Sequence; identical to SEQ ID NO: 93469
  derived and/or modified sequence opt2 from hemagglutinin__InfluenzaA__ACN32804

SEQ ID NO: 94046 - RNA, 1698 nt, Artificial Sequence; identical to SEQ ID NO: 93457
  derived and/or modified sequence opt2 from hemagglutinin__InfluenzaA__ACN32815

SEQ ID NO: 94047 - RNA, 1698 nt, Artificial Sequence; identical to SEQ ID NO: 93467
  derived and/or modified sequence opt2 from hemagglutinin__InfluenzaA__ACN32826

SEQ ID NO: 94048 - RNA, 1701 nt, Artificial Sequence; identical to SEQ ID NO: 93946
  derived and/or modified sequence opt2 from hemagglutinin__InfluenzaA__ACN32848

SEQ ID NO: 94049 - RNA, 1701 nt, Artificial Sequence
  derived and/or modified sequence opt2 from hemagglutinin__InfluenzaA__ACN32870
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94050 - RNA, 1701 nt, Artificial Sequence; identical to SEQ ID NO: 94049
  derived and/or modified sequence opt2 from hemagglutinin__InfluenzaA__ACN32892

SEQ ID NO: 94051 - RNA, 1701 nt, Artificial Sequence; identical to SEQ ID NO: 93946
  derived and/or modified sequence opt2 from hemagglutinin__InfluenzaA__ACN32903

SEQ ID NO: 94052 - RNA, 1701 nt, Artificial Sequence
  derived and/or modified sequence opt2 from hemagglutinin__InfluenzaA__ACN32914
augaagaccaucaucgcccucuccuacauccucugccucgccuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94053 - RNA, 1701 nt, Artificial Sequence; identical to SEQ ID NO: 93946
  derived and/or modified sequence opt2 from hemagglutinin__InfluenzaA__ACN32925

SEQ ID NO: 94054 - RNA, 1701 nt, Artificial Sequence
  derived and/or modified sequence opt2 from hemagglutinin__InfluenzaA__ACN32936
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcaucaagaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94055 - RNA, 1701 nt, Artificial Sequence; identical to SEQ ID NO: 93946
  derived and/or modified sequence opt2 from hemagglutinin__InfluenzaA__ACN32947

SEQ ID NO: 94056 - RNA, 1701 nt, Artificial Sequence
  derived and/or modified sequence opt2 from hemagglutinin__InfluenzaA__ACN32958
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94057 - RNA, 1701 nt, Artificial Sequence
  derived and/or modified sequence opt2 from hemagglutinin__InfluenzaA__ACN32969
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagcuccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgaggucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94058 - RNA, 1701 nt, Artificial Sequence
  derived and/or modified sequence opt2 from hemagglutinin__InfluenzaA__ACN32980
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaaguucaaguaccccgcccucaacgucaccaugcccaacgacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcgucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94059 - RNA, 1701 nt, Artificial Sequence; identical to SEQ ID NO: 93946
  derived and/or modified sequence opt2 from hemagglutinin__InfluenzaA__ACN32991

SEQ ID NO: 94060 - RNA, 1701 nt, Artificial Sequence; identical to SEQ ID NO: 93946
  derived and/or modified sequence opt2 from hemagglutinin__InfluenzaA__ACN33002

SEQ ID NO: 94061 - RNA, 1701 nt, Artificial Sequence; identical to SEQ ID NO: 93946
  derived and/or modified sequence opt2 from hemagglutinin__InfluenzaA__ACN33013

SEQ ID NO: 94062 - RNA, 1701 nt, Artificial Sequence
  derived and/or modified sequence opt2 from hemagglutinin__InfluenzaA__ACN33035
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacgucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94063 - RNA, 1701 nt, Artificial Sequence; identical to SEQ ID NO: 93946
  derived and/or modified sequence opt2 from hemagglutinin__InfluenzaA__ACN33046

SEQ ID NO: 94064 - RNA, 1701 nt, Artificial Sequence; identical to SEQ ID NO: 93946
  derived and/or modified sequence opt2 from hemagglutinin__InfluenzaA__ACN33057

SEQ ID NO: 94065 - RNA, 1701 nt, Artificial Sequence; identical to SEQ ID NO: 93946
  derived and/or modified sequence opt2 from hemagglutinin__InfluenzaA__ACN33068

SEQ ID NO: 94066 - RNA, 1701 nt, Artificial Sequence; identical to SEQ ID NO: 94049
  derived and/or modified sequence opt2 from hemagglutinin__InfluenzaA__ACN33079

SEQ ID NO: 94067 - RNA, 1698 nt, Artificial Sequence
  derived and/or modified sequence opt2 from hemagglutinin__InfluenzaA__ACN33090
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94068 - RNA, 1698 nt, Artificial Sequence; identical to SEQ ID NO: 93426
  derived and/or modified sequence opt2 from hemagglutinin__InfluenzaA__ACN33101

SEQ ID NO: 94069 - RNA, 1701 nt, Artificial Sequence; identical to SEQ ID NO: 94049
  derived and/or modified sequence opt2 from hemagglutinin__InfluenzaA__ACN33112

SEQ ID NO: 94070 - RNA, 1698 nt, Artificial Sequence; identical to SEQ ID NO: 94000
  derived and/or modified sequence opt2 from hemagglutinin__InfluenzaA__ACN33123

SEQ ID NO: 94071 - RNA, 1698 nt, Artificial Sequence; identical to SEQ ID NO: 94000
  derived and/or modified sequence opt2 from hemagglutinin__InfluenzaA__ACN33145

SEQ ID NO: 94072 - RNA, 1701 nt, Artificial Sequence; identical to SEQ ID NO: 93946
  derived and/or modified sequence opt2 from hemagglutinin__InfluenzaA__ACN33156

SEQ ID NO: 94073 - RNA, 1701 nt, Artificial Sequence
  derived and/or modified sequence opt2 from hemagglutinin__InfluenzaA__ACN33178
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94074 - RNA, 1701 nt, Artificial Sequence; identical to SEQ ID NO: 93946
  derived and/or modified sequence opt2 from hemagglutinin__InfluenzaA__ACN33189

SEQ ID NO: 94075 - RNA, 1701 nt, Artificial Sequence
  derived and/or modified sequence opt2 from hemagglutinin__InfluenzaA__ACN33200
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucgagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94076 - RNA, 1701 nt, Artificial Sequence
  derived and/or modified sequence opt2 from hemagglutinin__InfluenzaA__ACN33211
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucuccaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94077 - RNA, 1698 nt, Artificial Sequence; identical to SEQ ID NO: 93468
  derived and/or modified sequence opt2 from hemagglutinin__InfluenzaA__ACN42981

SEQ ID NO: 94078 - RNA, 1698 nt, Artificial Sequence; identical to SEQ ID NO: 93702
  derived and/or modified sequence opt2 from hemagglutinin__InfluenzaA__ACN42992

SEQ ID NO: 94079 - RNA, 1701 nt, Artificial Sequence; identical to SEQ ID NO: 93946
  derived and/or modified sequence opt2 from hemagglutinin__InfluenzaA__ACN43003

SEQ ID NO: 94080 - RNA, 1701 nt, Artificial Sequence
  derived and/or modified sequence opt2 from hemagglutinin__InfluenzaA__ACN43014
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaucggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcuccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94081 - RNA, 1701 nt, Artificial Sequence; identical to SEQ ID NO: 93946
  derived and/or modified sequence opt2 from hemagglutinin__InfluenzaA__ACN43025

SEQ ID NO: 94082 - RNA, 1701 nt, Artificial Sequence; identical to SEQ ID NO: 93946
  derived and/or modified sequence opt2 from hemagglutinin__InfluenzaA__ACN43036

SEQ ID NO: 94083 - RNA, 1701 nt, Artificial Sequence; identical to SEQ ID NO: 93946
  derived and/or modified sequence opt2 from hemagglutinin__InfluenzaA__ACN43047

SEQ ID NO: 94084 - RNA, 1701 nt, Artificial Sequence
  derived and/or modified sequence opt2 from hemagglutinin__InfluenzaA__ACN43058
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcggcuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94085 - RNA, 1701 nt, Artificial Sequence; identical to SEQ ID NO: 93946
  derived and/or modified sequence opt2 from hemagglutinin__InfluenzaA__ACN43069

SEQ ID NO: 94086 - RNA, 1701 nt, Artificial Sequence; identical to SEQ ID NO: 94049
  derived and/or modified sequence opt2 from hemagglutinin__InfluenzaA__ACN43080

SEQ ID NO: 94087 - RNA, 1701 nt, Artificial Sequence
  derived and/or modified sequence opt2 from hemagglutinin__InfluenzaA__ACN72617
auggaggccaagcucuucguccucuucugcgccuucaccgcccucaaggccgacaccaucugcgucggcuaccacgccaacaacuccaccgacaccgucgacaccauccucgagaagaacgucaccgucacccacuccgucaaccuccucgagaacucccacaacggcaagcucugcucccucaacggcaaggccccccuccagcucggcaacugcaacgucgccggcuggauccucggcaaccccgagugcgaccuccuccucaccgccaacuccugguccuacaucaucgagaccuccgacuccaagaacggcgccugcuaccccggcgaguucgccgacuacgaggagcuccgcgagcagcucuccaccgucuccuccuucgagcgcuucgagaucuuccccaaggccaccuccuggcccaaccacgagaccaccaagggcaccaccgucgccugcucccacuccggcgccaacuccuucuaccgcaaccuccucuggaucgucaagaagggcaacuccuaccccaagcucuccaaguccuacaccaacaacaagggcaaggagguccucgucaucuggggcguccaccacccccccaccgacuccgaccagcagacccucuaccagaacaagcacaccuacgucuccgucggcuccuccaaguacuaccagcgcuucacccccgagaucgucacccgccccaagguccgcgagcaggccggccgcaugaacuacuacuggacccuccucgaccagggcgacaccaucaccuucgaggccaccggcaaccucaucgcccccuggcacgccuucgcccucaacaagggcuccaacuccggcaucaugauguccgacgcccacguccacaacugcaccaccaagugccagaccccccacggcgcccucaagggcaaccuccccuuccagaacguccaccccaucaccaucggcgagugccccaaguacgucaaguccacccagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaucgccaucgacggcaucuccaacaaggucaacuccgucaucgagaagaugaacauccaguucaccuccgucggcaaggaguucaacaaccucgagaagcgcaucgagaaccucaacaagaaggucgacgacggcuuccucgacgucuggaccuacaacgccgagcuccucauccuccucgagaacgagcgcacccucgacuuccacgacuucaacgucaagaaccucuacgagaaggucaagucccagcuccgcaacaacgccaaggagaucggcaacggcugcuucgaguucuaccacaagugcgacaacgagugcauggaguccgucaagaacggcaccuacaacuacccccgcuacuccgaggaguccaagcucaaccgcgaggagaucgacggcgucaagcucgaguccgucggcguccaccagauccucgccaucuacuccaccgucgccuccucccucguccuccucgucucccucggcgccaucuccuucuggaugugcuccaacggcucccuccagugccgcaucugcaucuga

SEQ ID NO: 94088 - RNA, 1701 nt, Artificial Sequence
  derived and/or modified sequence opt2 from hemagglutinin__InfluenzaA__ACN72632
augaagaccgucaucgcccucuccuacgucuucugccucgucuucggccaggaccuccccggcaagggcaacaacaccgccacccucugccucggccaccacgccguccccaacggcacccucgucaagaccaucaccgacgaccagaucgaggucaccaacgccaccgagcucguccagaacuucuccaucggcaagaucugcaagaacccccaccgcauccucgacggcgccaacugcacccucaucgacucccuccucggcgacccccacugcgacggcuuccagaacgagaagugggaccucuucaucgagcgcuccaaggccuucuccaacugcuaccccuacgacguccccgaguacaccucccuccgcucccucaucgccuccuccggcacccucgaguucaccaacgaggacuucaacuggaccggcgucacccagaacggcggcuccuccgccugcaagcgcggccccaacaacuccuucuucucccgccucaacuggcucuacaaguccggcaacaccuaccccaugcucaacgucaccaugcccaacuccgacgacuucgacaagcucuacaucuggggcguccaccaccccuccaccgaccgcgagcagaccaaccucuacauccaggccuccggcaagaucaucgucuccaccaagcgcucccagcagaccaucauccccaacaucggcucccgccccuggguccgcggccucuccucccgcaucuccaucuacuggaccaucgucaagcccggcgacauccucaucaucaacuccaacggcaaccucaucgccccccgcggcuacuucaagauccagaccggcaaguccuccgucaugcgcuccgacgcccccaucggcaccugcaacuacgagugcaucacccccaacggcuccauccccaacgacaagcccuuccagaacgucaaccgcaucaccuacggcgccugcccccacuacaucaagcagaacacccucaagcucgccaccggcaugcgcaacauccccgagcgccagacccgcggcaucuucggcgccaucgccggcuucaucgagaacggcugggagggcauggucaacggcugguacggcuuccgccaccagaacuccgagggcaucggccaggccgccgaccucaaguccacccaggccgccaucaaccagaucaacggcaagcucaaccgcgucaucgagaagaccaacgagaaguuccaccagaucgagaaggaguucuccgaggucgagggccgcauccaggaccucgagcgcuacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacuccugcauggaguccauccgcaacggcaccuacgaccacaacgaguaccgcgacgaggccgucaacaaccgcuuccagaucaaguccgucgagcucaaguccggcuacaaggacuggauccucuggaucuccuucgccaucuccugcuuccuccucugcgccgucuggcucggcuucaucaucugggccugccagaagggcaacauccgcugcaacaucugcaucuga

SEQ ID NO: 94089 - RNA, 1701 nt, Artificial Sequence; identical to SEQ ID NO: 93946
  derived and/or modified sequence opt2 from hemagglutinin__InfluenzaA__ACN76478

SEQ ID NO: 94090 - RNA, 1701 nt, Artificial Sequence
  derived and/or modified sequence opt2 from hemagglutinin__InfluenzaA__ACN76489
augaagaccaucaucgcccucggcuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgaggucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94091 - RNA, 1701 nt, Artificial Sequence; identical to SEQ ID NO: 93946
  derived and/or modified sequence opt2 from hemagglutinin__InfluenzaA__ACN76500

SEQ ID NO: 94092 - RNA, 1701 nt, Artificial Sequence; identical to SEQ ID NO: 93946
  derived and/or modified sequence opt2 from hemagglutinin__InfluenzaA__ACN76511

SEQ ID NO: 94093 - RNA, 1701 nt, Artificial Sequence; identical to SEQ ID NO: 93946
  derived and/or modified sequence opt2 from hemagglutinin__InfluenzaA__ACN76522

SEQ ID NO: 94094 - RNA, 1701 nt, Artificial Sequence; identical to SEQ ID NO: 93946
  derived and/or modified sequence opt2 from hemagglutinin__InfluenzaA__ACO36331

SEQ ID NO: 94095 - RNA, 1701 nt, Artificial Sequence
  derived and/or modified sequence opt2 from hemagglutinin__InfluenzaA__ACO36342
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94096 - RNA, 1701 nt, Artificial Sequence
  derived and/or modified sequence opt2 from hemagglutinin__InfluenzaA__ACO36364
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94097 - RNA, 1701 nt, Artificial Sequence; identical to SEQ ID NO: 93813
  derived and/or modified sequence opt2 from hemagglutinin__InfluenzaA__ACO36375

SEQ ID NO: 94098 - RNA, 1698 nt, Artificial Sequence; identical to SEQ ID NO: 94000
  derived and/or modified sequence opt2 from hemagglutinin__InfluenzaA__ACO36397

SEQ ID NO: 94099 - RNA, 1701 nt, Artificial Sequence; identical to SEQ ID NO: 93813
  derived and/or modified sequence opt2 from hemagglutinin__InfluenzaA__ACO36408

SEQ ID NO: 94100 - RNA, 1701 nt, Artificial Sequence; identical to SEQ ID NO: 93440
  derived and/or modified sequence opt2 from hemagglutinin__InfluenzaA__ACO36419

SEQ ID NO: 94101 - RNA, 1701 nt, Artificial Sequence; identical to SEQ ID NO: 93440
  derived and/or modified sequence opt2 from hemagglutinin__InfluenzaA__ACO36430

SEQ ID NO: 94102 - RNA, 1701 nt, Artificial Sequence
  derived and/or modified sequence opt2 from hemagglutinin__InfluenzaA__ACO36441
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 94103 - RNA, 1701 nt, Artificial Sequence
  derived and/or modified sequence opt2 from hemagglutinin__InfluenzaA__ACO36452
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccuccugcaagcgccgcuccaacaacuccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccaucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94104 - RNA, 1701 nt, Artificial Sequence
  derived and/or modified sequence opt2 from hemagglutinin__InfluenzaA__ACO36463
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugccagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccagaccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuucguccucugcgucgcccuccucggcuucaucaugugggccugccagaagggcaacauccgcugcaacaucugcaucuga

SEQ ID NO: 94105 - RNA, 1701 nt, Artificial Sequence
  derived and/or modified sequence opt2 from hemagglutinin__InfluenzaA__ACO36474
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccuccugcaagcgccgcuccaacaacuccuucuucucccgccucaacuggcucacccaccuccgcuacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgacugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94106 - RNA, 1701 nt, Artificial Sequence
  derived and/or modified sequence opt2 from hemagglutinin__InfluenzaA__ACO36496
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacggcuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94107 - RNA, 1701 nt, Artificial Sequence
  derived and/or modified sequence opt2 from hemagglutinin__InfluenzaA__ACO36518
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagcucggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94108 - RNA, 1701 nt, Artificial Sequence
  derived and/or modified sequence opt2 from hemagglutinin__InfluenzaA__ACO36551
augaagaccaucaucgcccucucccacauccucugccucgucuucgcccagaagccccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94109 - RNA, 1701 nt, Artificial Sequence
  derived and/or modified sequence opt2 from hemagglutinin__InfluenzaA__ACO36562
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94110 - RNA, 1701 nt, Artificial Sequence
  derived and/or modified sequence opt2 from hemagglutinin__InfluenzaA__ACO36573
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94111 - RNA, 1701 nt, Artificial Sequence
  derived and/or modified sequence opt2 from hemagglutinin__InfluenzaA__ACO36584
augaagaccaucaucgcccucuccuacauccucugccucgucuucucccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagaagucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94112 - RNA, 1701 nt, Artificial Sequence; identical to SEQ ID NO: 92142
  derived and/or modified sequence opt2 from hemagglutinin__InfluenzaA__ACO36595

SEQ ID NO: 94113 - RNA, 1701 nt, Artificial Sequence
  derived and/or modified sequence opt2 from hemagglutinin__InfluenzaA__ACO36606
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaagaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccacccagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94114 - RNA, 1701 nt, Artificial Sequence; identical to SEQ ID NO: 92142
  derived and/or modified sequence opt2 from hemagglutinin__InfluenzaA__ACO36617

SEQ ID NO: 94115 - RNA, 1701 nt, Artificial Sequence; identical to SEQ ID NO: 92142
  derived and/or modified sequence opt2 from hemagglutinin__InfluenzaA__ACO36628

SEQ ID NO: 94116 - RNA, 1701 nt, Artificial Sequence
  derived and/or modified sequence opt2 from hemagglutinin__InfluenzaA__ACO36639
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcuucgcccuccucggcuucaucaugugggccugccagaagggcaacauccgcugcaacaucugcaucuga

SEQ ID NO: 94117 - RNA, 1701 nt, Artificial Sequence
  derived and/or modified sequence opt2 from hemagglutinin__InfluenzaA__ACO36661
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaucaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94118 - RNA, 1701 nt, Artificial Sequence; identical to SEQ ID NO: 92142
  derived and/or modified sequence opt2 from hemagglutinin__InfluenzaA__ACO36683

SEQ ID NO: 94119 - RNA, 1701 nt, Artificial Sequence; identical to SEQ ID NO: 94109
  derived and/or modified sequence opt2 from hemagglutinin__InfluenzaA__ACO37122

SEQ ID NO: 94120 - RNA, 1701 nt, Artificial Sequence
  derived and/or modified sequence opt2 from hemagglutinin__InfluenzaA__ACO94514
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94121 - RNA, 1701 nt, Artificial Sequence
  derived and/or modified sequence opt2 from hemagglutinin__InfluenzaA__ACO94515
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94122 - RNA, 1701 nt, Artificial Sequence; identical to SEQ ID NO: 93946
  derived and/or modified sequence opt2 from hemagglutinin__InfluenzaA__ACO94516

SEQ ID NO: 94123 - RNA, 1701 nt, Artificial Sequence; identical to SEQ ID NO: 93946
  derived and/or modified sequence opt2 from hemagglutinin__InfluenzaA__ACO94672

SEQ ID NO: 94124 - RNA, 1701 nt, Artificial Sequence
  derived and/or modified sequence opt2 from hemagglutinin__InfluenzaA__ACO94683
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgaggucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94125 - RNA, 1701 nt, Artificial Sequence; identical to SEQ ID NO: 93946
  derived and/or modified sequence opt2 from hemagglutinin__InfluenzaA__ACO94694

SEQ ID NO: 94126 - RNA, 1698 nt, Artificial Sequence; identical to SEQ ID NO: 94000
  derived and/or modified sequence opt2 from hemagglutinin__InfluenzaA__ACO94705

SEQ ID NO: 94127 - RNA, 1701 nt, Artificial Sequence
  derived and/or modified sequence opt2 from hemagglutinin__InfluenzaA__ACO94727
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 94128 - RNA, 1701 nt, Artificial Sequence
  derived and/or modified sequence opt2 from hemagglutinin__InfluenzaA__ACO94738
augaagaccaucaucgcccucuccuacauccagugccucgucuucgcccagaaguuccccggcaacgacaacuccaccgccacccucugccucggccaccacgccguccccaacggcaccgucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccgcgccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94129 - RNA, 1701 nt, Artificial Sequence; identical to SEQ ID NO: 94049
  derived and/or modified sequence opt2 from hemagglutinin__InfluenzaA__ACO94760

SEQ ID NO: 94130 - RNA, 1701 nt, Artificial Sequence
  derived and/or modified sequence opt2 from hemagglutinin__InfluenzaA__ACO94771
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 94131 - RNA, 1701 nt, Artificial Sequence; identical to SEQ ID NO: 93946
  derived and/or modified sequence opt2 from hemagglutinin__InfluenzaA__ACO94782

SEQ ID NO: 94132 - RNA, 1701 nt, Artificial Sequence; identical to SEQ ID NO: 93946
  derived and/or modified sequence opt2 from hemagglutinin__InfluenzaA__ACO94793

SEQ ID NO: 94133 - RNA, 1698 nt, Artificial Sequence
  derived and/or modified sequence opt2 from hemagglutinin__InfluenzaA__ACO94804
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacggcugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccuacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94134 - RNA, 1701 nt, Artificial Sequence; identical to SEQ ID NO: 93813
  derived and/or modified sequence opt2 from hemagglutinin__InfluenzaA__ACO94815

SEQ ID NO: 94135 - RNA, 1701 nt, Artificial Sequence; identical to SEQ ID NO: 93820
  derived and/or modified sequence opt2 from hemagglutinin__InfluenzaA__ACO94848

SEQ ID NO: 94136 - RNA, 1698 nt, Artificial Sequence; identical to SEQ ID NO: 94000
  derived and/or modified sequence opt2 from hemagglutinin__InfluenzaA__ACO94859

SEQ ID NO: 94137 - RNA, 1698 nt, Artificial Sequence
  derived and/or modified sequence opt2 from hemagglutinin__InfluenzaA__ACO94870
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucaaccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94138 - RNA, 1701 nt, Artificial Sequence
  derived and/or modified sequence opt2 from hemagglutinin__InfluenzaA__ACO94881
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccuccugcaagcgccgcuccaacaacuccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccaccgcugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94139 - RNA, 1701 nt, Artificial Sequence
  derived and/or modified sequence opt2 from hemagglutinin__InfluenzaA__ACO94892
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugccagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccagaccuccggccgcaucaccaucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgucaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94140 - RNA, 1701 nt, Artificial Sequence
  derived and/or modified sequence opt2 from hemagglutinin__InfluenzaA__ACO94903
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccgaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94141 - RNA, 1701 nt, Artificial Sequence
  derived and/or modified sequence opt2 from hemagglutinin__InfluenzaA__ACO94925
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94142 - RNA, 1701 nt, Artificial Sequence
  derived and/or modified sequence opt2 from hemagglutinin__InfluenzaA__ACO94936
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgaggacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccuccugcaagcgccgcuccaacaacuccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94143 - RNA, 1701 nt, Artificial Sequence
  derived and/or modified sequence opt2 from hemagglutinin__InfluenzaA__ACO94947
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94144 - RNA, 1701 nt, Artificial Sequence
  derived and/or modified sequence opt2 from hemagglutinin__InfluenzaA__ACO95153
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94145 - RNA, 1701 nt, Artificial Sequence; identical to SEQ ID NO: 94110
  derived and/or modified sequence opt2 from hemagglutinin__InfluenzaA__ACO95171

SEQ ID NO: 94146 - RNA, 1701 nt, Artificial Sequence
  derived and/or modified sequence opt2 from hemagglutinin__InfluenzaA__ACO95193
augaagaccaucaucgcccucuccuacauccucugccucgucuucgcccagaagcuccccggcaacgacaaguccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94147 - RNA, 1701 nt, Artificial Sequence; identical to SEQ ID NO: 94109
  derived and/or modified sequence opt2 from hemagglutinin__InfluenzaA__ACO95204

SEQ ID NO: 94148 - RNA, 1701 nt, Artificial Sequence
  derived and/or modified sequence opt2 from hemagglutinin__InfluenzaA__ACO95215
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaaguccgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94149 - RNA, 1701 nt, Artificial Sequence; identical to SEQ ID NO: 91793
  derived and/or modified sequence opt2 from hemagglutinin__InfluenzaA__ACO95226

SEQ ID NO: 94150 - RNA, 1701 nt, Artificial Sequence; identical to SEQ ID NO: 92142
  derived and/or modified sequence opt2 from hemagglutinin__InfluenzaA__ACO95248

SEQ ID NO: 94151 - RNA, 1701 nt, Artificial Sequence
  derived and/or modified sequence opt2 from hemagglutinin__InfluenzaA__ACO95270
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacaaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94152 - RNA, 1701 nt, Artificial Sequence; identical to SEQ ID NO: 93946
  derived and/or modified sequence opt2 from hemagglutinin__InfluenzaA__ACO95281

SEQ ID NO: 94153 - RNA, 1701 nt, Artificial Sequence
  derived and/or modified sequence opt2 from hemagglutinin__InfluenzaA__ACO95292
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94154 - RNA, 1701 nt, Artificial Sequence; identical to SEQ ID NO: 94049
  derived and/or modified sequence opt2 from hemagglutinin__InfluenzaA__ACO95303

SEQ ID NO: 94155 - RNA, 1698 nt, Artificial Sequence
  derived and/or modified sequence opt2 from hemagglutinin__InfluenzaA__ACO95382
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggagggcuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94156 - RNA, 1698 nt, Artificial Sequence
  derived and/or modified sequence opt2 from hemagglutinin__InfluenzaA__ACO95415
augaaggucaagcuccucguccuccucugcaccuucaccgccaccuacgccgacaccaucugcaucggcuaccacgccaacaacuccaccgacaccaucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94157 - RNA, 1701 nt, Artificial Sequence
  derived and/or modified sequence opt2 from hemagglutinin__InfluenzaA__ACO95426
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccuccugcaagcgccgcuccaacaacuccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94158 - RNA, 1701 nt, Artificial Sequence; identical to SEQ ID NO: 93307
  derived and/or modified sequence opt2 from hemagglutinin__InfluenzaA__ACO95437

SEQ ID NO: 94159 - RNA, 1701 nt, Artificial Sequence
  derived and/or modified sequence opt2 from hemagglutinin__InfluenzaA__ACO95448
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucaaccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94160 - RNA, 1701 nt, Artificial Sequence; identical to SEQ ID NO: 92142
  derived and/or modified sequence opt2 from hemagglutinin__InfluenzaA__ACO95459

SEQ ID NO: 94161 - RNA, 1701 nt, Artificial Sequence
  derived and/or modified sequence opt2 from hemagglutinin__InfluenzaA__ACO95470
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggccgcugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94162 - RNA, 1701 nt, Artificial Sequence
  derived and/or modified sequence opt2 from hemagglutinin__InfluenzaA__ACO95481
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaaccuccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94163 - RNA, 1701 nt, Artificial Sequence; identical to SEQ ID NO: 92142
  derived and/or modified sequence opt2 from hemagglutinin__InfluenzaA__ACO95492

SEQ ID NO: 94164 - RNA, 1701 nt, Artificial Sequence; identical to SEQ ID NO: 92142
  derived and/or modified sequence opt2 from hemagglutinin__InfluenzaA__ACO95503

SEQ ID NO: 94165 - RNA, 1701 nt, Artificial Sequence; identical to SEQ ID NO: 92142
  derived and/or modified sequence opt2 from hemagglutinin__InfluenzaA__ACO95514

SEQ ID NO: 94166 - RNA, 1701 nt, Artificial Sequence; identical to SEQ ID NO: 92142
  derived and/or modified sequence opt2 from hemagglutinin__InfluenzaA__ACO95536

SEQ ID NO: 94167 - RNA, 1701 nt, Artificial Sequence; identical to SEQ ID NO: 92142
  derived and/or modified sequence opt2 from hemagglutinin__InfluenzaA__ACO95547

SEQ ID NO: 94168 - RNA, 1701 nt, Artificial Sequence
  derived and/or modified sequence opt2 from hemagglutinin__InfluenzaA__ACP41963
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94169 - RNA, 1698 nt, Artificial Sequence; identical to SEQ ID NO: 94155
  derived and/or modified sequence opt2 from hemagglutinin__InfluenzaA__ACP44192

SEQ ID NO: 94170 - RNA, 1698 nt, Artificial Sequence; identical to SEQ ID NO: 94155
  derived and/or modified sequence opt2 from hemagglutinin__InfluenzaA__ACP44203

SEQ ID NO: 94171 - RNA, 1698 nt, Artificial Sequence
  derived and/or modified sequence opt2 from hemagglutinin__InfluenzaA__ACP44225
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcggccuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94172 - RNA, 1701 nt, Artificial Sequence
  derived and/or modified sequence opt2 from hemagglutinin__InfluenzaA__ACP44236
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccgacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94173 - RNA, 1701 nt, Artificial Sequence; identical to SEQ ID NO: 94109
  derived and/or modified sequence opt2 from hemagglutinin__InfluenzaA__ACP44247

SEQ ID NO: 94174 - RNA, 1701 nt, Artificial Sequence; identical to SEQ ID NO: 92142
  derived and/or modified sequence opt2 from hemagglutinin__InfluenzaA__ACP44258

SEQ ID NO: 94175 - RNA, 1701 nt, Artificial Sequence; identical to SEQ ID NO: 92142
  derived and/or modified sequence opt2 from hemagglutinin__InfluenzaA__ACP44269

SEQ ID NO: 94176 - RNA, 1701 nt, Artificial Sequence; identical to SEQ ID NO: 94168
  derived and/or modified sequence opt2 from hemagglutinin__InfluenzaA__ACQ44554

SEQ ID NO: 94177 - RNA, 1701 nt, Artificial Sequence; identical to SEQ ID NO: 94168
  derived and/or modified sequence opt2 from hemagglutinin__InfluenzaA__ACQ44556

SEQ ID NO: 94178 - RNA, 1701 nt, Artificial Sequence; identical to SEQ ID NO: 94168
  derived and/or modified sequence opt2 from hemagglutinin__InfluenzaA__ACQ45338

SEQ ID NO: 94179 - RNA, 1701 nt, Artificial Sequence
  derived and/or modified sequence opt2 from hemagglutinin__InfluenzaA__ACQ55359
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94180 - RNA, 1701 nt, Artificial Sequence; identical to SEQ ID NO: 94168
  derived and/or modified sequence opt2 from hemagglutinin__InfluenzaA__ACQ55361

SEQ ID NO: 94181 - RNA, 1701 nt, Artificial Sequence
  derived and/or modified sequence opt2 from hemagglutinin__InfluenzaA__ACQ63223
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94182 - RNA, 1701 nt, Artificial Sequence; identical to SEQ ID NO: 94181
  derived and/or modified sequence opt2 from hemagglutinin__InfluenzaA__ACQ63239

SEQ ID NO: 94183 - RNA, 1701 nt, Artificial Sequence; identical to SEQ ID NO: 94181
  derived and/or modified sequence opt2 from hemagglutinin__InfluenzaA__ACQ63244

SEQ ID NO: 94184 - RNA, 1701 nt, Artificial Sequence; identical to SEQ ID NO: 94181
  derived and/or modified sequence opt2 from hemagglutinin__InfluenzaA__ACQ63257

SEQ ID NO: 94185 - RNA, 1701 nt, Artificial Sequence
  derived and/or modified sequence opt2 from hemagglutinin__InfluenzaA__ACQ65691
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaagcgcggcuccgacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucaccaucuccugcuuccuccucugcgucgcccuccucggcuucaucaugugggccugccagaagggcaacauccgcugcaacaucugcaucuga

SEQ ID NO: 94186 - RNA, 1701 nt, Artificial Sequence; identical to SEQ ID NO: 93946
  derived and/or modified sequence opt2 from hemagglutinin__InfluenzaA__ACQ65713

SEQ ID NO: 94187 - RNA, 1701 nt, Artificial Sequence
  derived and/or modified sequence opt2 from hemagglutinin__InfluenzaA__ACQ65724
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94188 - RNA, 1701 nt, Artificial Sequence
  derived and/or modified sequence opt2 from hemagglutinin__InfluenzaA__ACQ65747
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcaccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaucggccaggccgccgaccucaaguccacccaggccgccaucgaccagaucaacggcaagcucaacggccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94189 - RNA, 1698 nt, Artificial Sequence
  derived and/or modified sequence opt2 from hemagglutinin__InfluenzaA__ACQ65758
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacgucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94190 - RNA, 1701 nt, Artificial Sequence; identical to SEQ ID NO: 94168
  derived and/or modified sequence opt2 from hemagglutinin__InfluenzaA__ACQ73386

SEQ ID NO: 94191 - RNA, 1701 nt, Artificial Sequence; identical to SEQ ID NO: 94181
  derived and/or modified sequence opt2 from hemagglutinin__InfluenzaA__ACQ73387

SEQ ID NO: 94192 - RNA, 1701 nt, Artificial Sequence
  derived and/or modified sequence opt2 from hemagglutinin__InfluenzaA__ACQ73555
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaagcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94193 - RNA, 1701 nt, Artificial Sequence; identical to SEQ ID NO: 94181
  derived and/or modified sequence opt2 from hemagglutinin__InfluenzaA__ACQ76294

SEQ ID NO: 94194 - RNA, 1701 nt, Artificial Sequence; identical to SEQ ID NO: 94181
  derived and/or modified sequence opt2 from hemagglutinin__InfluenzaA__ACQ76314

SEQ ID NO: 94195 - RNA, 1701 nt, Artificial Sequence; identical to SEQ ID NO: 94181
  derived and/or modified sequence opt2 from hemagglutinin__InfluenzaA__ACQ76317

SEQ ID NO: 94196 - RNA, 1701 nt, Artificial Sequence
  derived and/or modified sequence opt2 from hemagglutinin__InfluenzaA__ACQ76318
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94197 - RNA, 1701 nt, Artificial Sequence; identical to SEQ ID NO: 94168
  derived and/or modified sequence opt2 from hemagglutinin__InfluenzaA__ACQ76326

SEQ ID NO: 94198 - RNA, 1701 nt, Artificial Sequence; identical to SEQ ID NO: 94168
  derived and/or modified sequence opt2 from hemagglutinin__InfluenzaA__ACQ76336

SEQ ID NO: 94199 - RNA, 1701 nt, Artificial Sequence; identical to SEQ ID NO: 94168
  derived and/or modified sequence opt2 from hemagglutinin__InfluenzaA__ACQ76347

SEQ ID NO: 94200 - RNA, 1701 nt, Artificial Sequence; identical to SEQ ID NO: 94181
  derived and/or modified sequence opt2 from hemagglutinin__InfluenzaA__ACQ76365

SEQ ID NO: 94201 - RNA, 1701 nt, Artificial Sequence; identical to SEQ ID NO: 94181
  derived and/or modified sequence opt2 from hemagglutinin__InfluenzaA__ACQ76370

SEQ ID NO: 94202 - RNA, 1701 nt, Artificial Sequence; identical to SEQ ID NO: 94168
  derived and/or modified sequence opt2 from hemagglutinin__InfluenzaA__ACQ76376

SEQ ID NO: 94203 - RNA, 1701 nt, Artificial Sequence
  derived and/or modified sequence opt2 from hemagglutinin__InfluenzaA__ACQ76383
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94204 - RNA, 1701 nt, Artificial Sequence; identical to SEQ ID NO: 94181
  derived and/or modified sequence opt2 from hemagglutinin__InfluenzaA__ACQ76389

SEQ ID NO: 94205 - RNA, 1701 nt, Artificial Sequence; identical to SEQ ID NO: 94168
  derived and/or modified sequence opt2 from hemagglutinin__InfluenzaA__ACQ76401

SEQ ID NO: 94206 - RNA, 1701 nt, Artificial Sequence; identical to SEQ ID NO: 94181
  derived and/or modified sequence opt2 from hemagglutinin__InfluenzaA__ACQ76405

SEQ ID NO: 94207 - RNA, 1701 nt, Artificial Sequence
  derived and/or modified sequence opt2 from hemagglutinin__InfluenzaA__ACQ76408
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94208 - RNA, 1701 nt, Artificial Sequence
  derived and/or modified sequence opt2 from hemagglutinin__InfluenzaA__ACQ77601
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucgagaaccgcuaccccgcccccaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94209 - RNA, 1701 nt, Artificial Sequence
  derived and/or modified sequence opt2 from hemagglutinin__InfluenzaA__ACQ83310
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccauguccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaagcucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94210 - RNA, 1701 nt, Artificial Sequence; identical to SEQ ID NO: 94168
  derived and/or modified sequence opt2 from hemagglutinin__InfluenzaA__ACQ84451

SEQ ID NO: 94211 - RNA, 1701 nt, Artificial Sequence; identical to SEQ ID NO: 94168
  derived and/or modified sequence opt2 from hemagglutinin__InfluenzaA__ACQ84457

SEQ ID NO: 94212 - RNA, 1701 nt, Artificial Sequence
  derived and/or modified sequence opt2 from hemagglutinin__InfluenzaA__ACQ84477
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccgaccacgagaccaaccgcggcgucaccgccgccugccccuacgccggcgccaacuccuucuaccgcaaccucaucuggcucgucaagaagggcaacuccuaccccaagcucuccaaguccuacgucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 94213 - RNA, 1701 nt, Artificial Sequence
  derived and/or modified sequence opt2 from hemagglutinin__InfluenzaA__ACQ89900
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucgucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94214 - RNA, 1701 nt, Artificial Sequence; identical to SEQ ID NO: 94181
  derived and/or modified sequence opt2 from hemagglutinin__InfluenzaA__ACQ89902

SEQ ID NO: 94215 - RNA, 1701 nt, Artificial Sequence
  derived and/or modified sequence opt2 from hemagglutinin__InfluenzaA__ACQ89904
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaagggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94216 - RNA, 1701 nt, Artificial Sequence; identical to SEQ ID NO: 94213
  derived and/or modified sequence opt2 from hemagglutinin__InfluenzaA__ACQ89905

SEQ ID NO: 94217 - RNA, 1701 nt, Artificial Sequence; identical to SEQ ID NO: 94168
  derived and/or modified sequence opt2 from hemagglutinin__InfluenzaA__ACQ99607

SEQ ID NO: 94218 - RNA, 1701 nt, Artificial Sequence; identical to SEQ ID NO: 94168
  derived and/or modified sequence opt2 from hemagglutinin__InfluenzaA__ACQ99608

SEQ ID NO: 94219 - RNA, 1701 nt, Artificial Sequence; identical to SEQ ID NO: 94168
  derived and/or modified sequence opt2 from hemagglutinin__InfluenzaA__ACQ99609

SEQ ID NO: 94220 - RNA, 1701 nt, Artificial Sequence; identical to SEQ ID NO: 94168
  derived and/or modified sequence opt2 from hemagglutinin__InfluenzaA__ACQ99611

SEQ ID NO: 94221 - RNA, 1701 nt, Artificial Sequence
  derived and/or modified sequence opt2 from hemagglutinin__InfluenzaA__ACQ99614
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94222 - RNA, 1701 nt, Artificial Sequence; identical to SEQ ID NO: 94221
  derived and/or modified sequence opt2 from hemagglutinin__InfluenzaA__ACQ99616

SEQ ID NO: 94223 - RNA, 1701 nt, Artificial Sequence; identical to SEQ ID NO: 94168
  derived and/or modified sequence opt2 from hemagglutinin__InfluenzaA__ACQ99617

SEQ ID NO: 94224 - RNA, 1701 nt, Artificial Sequence; identical to SEQ ID NO: 94168
  derived and/or modified sequence opt2 from hemagglutinin__InfluenzaA__ACQ99618

SEQ ID NO: 94225 - RNA, 1701 nt, Artificial Sequence; identical to SEQ ID NO: 94168
  derived and/or modified sequence opt2 from hemagglutinin__InfluenzaA__ACQ99619

SEQ ID NO: 94226 - RNA, 1701 nt, Artificial Sequence; identical to SEQ ID NO: 94168
  derived and/or modified sequence opt2 from hemagglutinin__InfluenzaA__ACQ99620

SEQ ID NO: 94227 - RNA, 1701 nt, Artificial Sequence; identical to SEQ ID NO: 94221
  derived and/or modified sequence opt2 from hemagglutinin__InfluenzaA__ACQ99621

SEQ ID NO: 94228 - RNA, 1701 nt, Artificial Sequence; identical to SEQ ID NO: 94168
  derived and/or modified sequence opt2 from hemagglutinin__InfluenzaA__ACQ99622

SEQ ID NO: 94229 - RNA, 1701 nt, Artificial Sequence
  derived and/or modified sequence opt2 from hemagglutinin__InfluenzaA__ACR01014
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcauggagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94230 - RNA, 1701 nt, Artificial Sequence; identical to SEQ ID NO: 94181
  derived and/or modified sequence opt2 from hemagglutinin__InfluenzaA__ACR08419

SEQ ID NO: 94231 - RNA, 1701 nt, Artificial Sequence
  derived and/or modified sequence opt2 from hemagglutinin__InfluenzaA__ACR08429
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94232 - RNA, 1701 nt, Artificial Sequence; identical to SEQ ID NO: 94181
  derived and/or modified sequence opt2 from hemagglutinin__InfluenzaA__ACR08439

SEQ ID NO: 94233 - RNA, 1701 nt, Artificial Sequence; identical to SEQ ID NO: 94181
  derived and/or modified sequence opt2 from hemagglutinin__InfluenzaA__ACR08449

SEQ ID NO: 94234 - RNA, 1701 nt, Artificial Sequence
  derived and/or modified sequence opt2 from hemagglutinin__InfluenzaA__ACR08459
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcgacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94235 - RNA, 1701 nt, Artificial Sequence; identical to SEQ ID NO: 94168
  derived and/or modified sequence opt2 from hemagglutinin__InfluenzaA__ACR08528

SEQ ID NO: 94236 - RNA, 1701 nt, Artificial Sequence; identical to SEQ ID NO: 94168
  derived and/or modified sequence opt2 from hemagglutinin__InfluenzaA__ACR08530

SEQ ID NO: 94237 - RNA, 1701 nt, Artificial Sequence; identical to SEQ ID NO: 94234
  derived and/or modified sequence opt2 from hemagglutinin__InfluenzaA__ACR08531

SEQ ID NO: 94238 - RNA, 1701 nt, Artificial Sequence; identical to SEQ ID NO: 94181
  derived and/or modified sequence opt2 from hemagglutinin__InfluenzaA__ACR08533

SEQ ID NO: 94239 - RNA, 1701 nt, Artificial Sequence; identical to SEQ ID NO: 94234
  derived and/or modified sequence opt2 from hemagglutinin__InfluenzaA__ACR08535

SEQ ID NO: 94240 - RNA, 1701 nt, Artificial Sequence; identical to SEQ ID NO: 94181
  derived and/or modified sequence opt2 from hemagglutinin__InfluenzaA__ACR08536

SEQ ID NO: 94241 - RNA, 1701 nt, Artificial Sequence; identical to SEQ ID NO: 94234
  derived and/or modified sequence opt2 from hemagglutinin__InfluenzaA__ACR08537

SEQ ID NO: 94242 - RNA, 1701 nt, Artificial Sequence; identical to SEQ ID NO: 94234
  derived and/or modified sequence opt2 from hemagglutinin__InfluenzaA__ACR08538

SEQ ID NO: 94243 - RNA, 1701 nt, Artificial Sequence; identical to SEQ ID NO: 94181
  derived and/or modified sequence opt2 from hemagglutinin__InfluenzaA__ACR08539

SEQ ID NO: 94244 - RNA, 1701 nt, Artificial Sequence; identical to SEQ ID NO: 94181
  derived and/or modified sequence opt2 from hemagglutinin__InfluenzaA__ACR08540

SEQ ID NO: 94245 - RNA, 1701 nt, Artificial Sequence; identical to SEQ ID NO: 94168
  derived and/or modified sequence opt2 from hemagglutinin__InfluenzaA__ACR08542

SEQ ID NO: 94246 - RNA, 1701 nt, Artificial Sequence; identical to SEQ ID NO: 94168
  derived and/or modified sequence opt2 from hemagglutinin__InfluenzaA__ACR08543

SEQ ID NO: 94247 - RNA, 1701 nt, Artificial Sequence; identical to SEQ ID NO: 94207
  derived and/or modified sequence opt2 from hemagglutinin__InfluenzaA__ACR08544

SEQ ID NO: 94248 - RNA, 1701 nt, Artificial Sequence; identical to SEQ ID NO: 94234
  derived and/or modified sequence opt2 from hemagglutinin__InfluenzaA__ACR08545

SEQ ID NO: 94249 - RNA, 1701 nt, Artificial Sequence; identical to SEQ ID NO: 94168
  derived and/or modified sequence opt2 from hemagglutinin__InfluenzaA__ACR08546

SEQ ID NO: 94250 - RNA, 1701 nt, Artificial Sequence; identical to SEQ ID NO: 94181
  derived and/or modified sequence opt2 from hemagglutinin__InfluenzaA__ACR08547

SEQ ID NO: 94251 - RNA, 1701 nt, Artificial Sequence; identical to SEQ ID NO: 94234
  derived and/or modified sequence opt2 from hemagglutinin__InfluenzaA__ACR08548

SEQ ID NO: 94252 - RNA, 1701 nt, Artificial Sequence; identical to SEQ ID NO: 94181
  derived and/or modified sequence opt2 from hemagglutinin__InfluenzaA__ACR08549

SEQ ID NO: 94253 - RNA, 1701 nt, Artificial Sequence; identical to SEQ ID NO: 94181
  derived and/or modified sequence opt2 from hemagglutinin__InfluenzaA__ACR08550

SEQ ID NO: 94254 - RNA, 1701 nt, Artificial Sequence; identical to SEQ ID NO: 94181
  derived and/or modified sequence opt2 from hemagglutinin__InfluenzaA__ACR08551

SEQ ID NO: 94255 - RNA, 1701 nt, Artificial Sequence; identical to SEQ ID NO: 94168
  derived and/or modified sequence opt2 from hemagglutinin__InfluenzaA__ACR08552

SEQ ID NO: 94256 - RNA, 1701 nt, Artificial Sequence; identical to SEQ ID NO: 94207
  derived and/or modified sequence opt2 from hemagglutinin__InfluenzaA__ACR08553

SEQ ID NO: 94257 - RNA, 1701 nt, Artificial Sequence; identical to SEQ ID NO: 94207
  derived and/or modified sequence opt2 from hemagglutinin__InfluenzaA__ACR08554

SEQ ID NO: 94258 - RNA, 1701 nt, Artificial Sequence; identical to SEQ ID NO: 94168
  derived and/or modified sequence opt2 from hemagglutinin__InfluenzaA__ACR09365

SEQ ID NO: 94259 - RNA, 1701 nt, Artificial Sequence; identical to SEQ ID NO: 94168
  derived and/or modified sequence opt2 from hemagglutinin__InfluenzaA__ACR09366

SEQ ID NO: 94260 - RNA, 1701 nt, Artificial Sequence; identical to SEQ ID NO: 94168
  derived and/or modified sequence opt2 from hemagglutinin__InfluenzaA__ACR09367

SEQ ID NO: 94261 - RNA, 1701 nt, Artificial Sequence; identical to SEQ ID NO: 94168
  derived and/or modified sequence opt2 from hemagglutinin__InfluenzaA__ACR09368

SEQ ID NO: 94262 - RNA, 1701 nt, Artificial Sequence; identical to SEQ ID NO: 94168
  derived and/or modified sequence opt2 from hemagglutinin__InfluenzaA__ACR09369

SEQ ID NO: 94263 - RNA, 1701 nt, Artificial Sequence; identical to SEQ ID NO: 94168
  derived and/or modified sequence opt2 from hemagglutinin__InfluenzaA__ACR09370

SEQ ID NO: 94264 - RNA, 1701 nt, Artificial Sequence; identical to SEQ ID NO: 94168
  derived and/or modified sequence opt2 from hemagglutinin__InfluenzaA__ACR09371

SEQ ID NO: 94265 - RNA, 1701 nt, Artificial Sequence; identical to SEQ ID NO: 94168
  derived and/or modified sequence opt2 from hemagglutinin__InfluenzaA__ACR09373

SEQ ID NO: 94266 - RNA, 1701 nt, Artificial Sequence; identical to SEQ ID NO: 94168
  derived and/or modified sequence opt2 from hemagglutinin__InfluenzaA__ACR09374

SEQ ID NO: 94267 - RNA, 1701 nt, Artificial Sequence
  derived and/or modified sequence opt2 from hemagglutinin__InfluenzaA__ACR09375
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94268 - RNA, 1701 nt, Artificial Sequence; identical to SEQ ID NO: 94168
  derived and/or modified sequence opt2 from hemagglutinin__InfluenzaA__ACR09376

SEQ ID NO: 94269 - RNA, 1701 nt, Artificial Sequence; identical to SEQ ID NO: 94168
  derived and/or modified sequence opt2 from hemagglutinin__InfluenzaA__ACR09377

SEQ ID NO: 94270 - RNA, 1701 nt, Artificial Sequence; identical to SEQ ID NO: 94168
  derived and/or modified sequence opt2 from hemagglutinin__InfluenzaA__ACR09395

SEQ ID NO: 94271 - RNA, 1701 nt, Artificial Sequence; identical to SEQ ID NO: 94168
  derived and/or modified sequence opt2 from hemagglutinin__InfluenzaA__ACR09396

SEQ ID NO: 94272 - RNA, 1701 nt, Artificial Sequence
  derived and/or modified sequence opt2 from hemagglutinin__InfluenzaA__ACR10186
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94273 - RNA, 1701 nt, Artificial Sequence; identical to SEQ ID NO: 94272
  derived and/or modified sequence opt2 from hemagglutinin__InfluenzaA__ACR10222

SEQ ID NO: 94274 - RNA, 1701 nt, Artificial Sequence
  derived and/or modified sequence opt2 from hemagglutinin__InfluenzaA__ACR10223
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94275 - RNA, 1701 nt, Artificial Sequence
  derived and/or modified sequence opt2 from hemagglutinin__InfluenzaA__ACR15183
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccgacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94276 - RNA, 1698 nt, Artificial Sequence
  derived and/or modified sequence opt2 from hemagglutinin__InfluenzaA__ACR15194
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggccucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaaccgcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94277 - RNA, 1698 nt, Artificial Sequence; identical to SEQ ID NO: 92382
  derived and/or modified sequence opt2 from hemagglutinin__InfluenzaA__ACR15216

SEQ ID NO: 94278 - RNA, 1701 nt, Artificial Sequence
  derived and/or modified sequence opt2 from hemagglutinin__InfluenzaA__ACR15227
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugccagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccagaccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94279 - RNA, 1698 nt, Artificial Sequence
  derived and/or modified sequence opt2 from hemagglutinin__InfluenzaA__ACR15238
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccagcaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94280 - RNA, 1701 nt, Artificial Sequence
  derived and/or modified sequence opt2 from hemagglutinin__InfluenzaA__ACR15249
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94281 - RNA, 1701 nt, Artificial Sequence
  derived and/or modified sequence opt2 from hemagglutinin__InfluenzaA__ACR15282
augaagaccaucaucgcccucuccuacauccucugccucgucuucgcccagaagcuccccggcaacgacaacuccaccgccacccucugccucggccaccacgccguccccaacggcaccaucgucaagaccaucaugaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94282 - RNA, 1701 nt, Artificial Sequence
  derived and/or modified sequence opt2 from hemagglutinin__InfluenzaA__ACR15293
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgagaacuucaacuggaccggcgucacccagaacggcaccuccuccgccugcaagcgcggcuccgacaacuccuucuucucccgccucaacuggcucacccaccucaaguucaaguaccccgcccucaaggucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94283 - RNA, 1698 nt, Artificial Sequence
  derived and/or modified sequence opt2 from hemagglutinin__InfluenzaA__ACR15304
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaccggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaaccgccucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94284 - RNA, 1698 nt, Artificial Sequence
  derived and/or modified sequence opt2 from hemagglutinin__InfluenzaA__ACR15315
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacauccgcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94285 - RNA, 1698 nt, Artificial Sequence
  derived and/or modified sequence opt2 from hemagglutinin__InfluenzaA__ACR15326
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgagaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94286 - RNA, 1698 nt, Artificial Sequence
  derived and/or modified sequence opt2 from hemagglutinin__InfluenzaA__ACR15359
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcggccuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94287 - RNA, 1698 nt, Artificial Sequence
  derived and/or modified sequence opt2 from hemagglutinin__InfluenzaA__ACR15370
augaaggucaagcuccucguccuccucugcacccucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucauccuccucgucucccucggcgccaucuccuucuggaugugcuccaacggcucccuccagugccgcaucugcaucuga

SEQ ID NO: 94288 - RNA, 1701 nt, Artificial Sequence; identical to SEQ ID NO: 93813
  derived and/or modified sequence opt2 from hemagglutinin__InfluenzaA__ACR15381

SEQ ID NO: 94289 - RNA, 1701 nt, Artificial Sequence; identical to SEQ ID NO: 93820
  derived and/or modified sequence opt2 from hemagglutinin__InfluenzaA__ACR15392

SEQ ID NO: 94290 - RNA, 1701 nt, Artificial Sequence; identical to SEQ ID NO: 93440
  derived and/or modified sequence opt2 from hemagglutinin__InfluenzaA__ACR15403

SEQ ID NO: 94291 - RNA, 1701 nt, Artificial Sequence; identical to SEQ ID NO: 93440
  derived and/or modified sequence opt2 from hemagglutinin__InfluenzaA__ACR15414

SEQ ID NO: 94292 - RNA, 1698 nt, Artificial Sequence; identical to SEQ ID NO: 94286
  derived and/or modified sequence opt2 from hemagglutinin__InfluenzaA__ACR15425

SEQ ID NO: 94293 - RNA, 1698 nt, Artificial Sequence
  derived and/or modified sequence opt2 from hemagglutinin__InfluenzaA__ACR15436
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94294 - RNA, 1698 nt, Artificial Sequence
  derived and/or modified sequence opt2 from hemagglutinin__InfluenzaA__ACR15458
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaaccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94295 - RNA, 1698 nt, Artificial Sequence
  derived and/or modified sequence opt2 from hemagglutinin__InfluenzaA__ACR15469
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccgaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94296 - RNA, 1698 nt, Artificial Sequence; identical to SEQ ID NO: 94293
  derived and/or modified sequence opt2 from hemagglutinin__InfluenzaA__ACR15480

SEQ ID NO: 94297 - RNA, 1698 nt, Artificial Sequence
  derived and/or modified sequence opt2 from hemagglutinin__InfluenzaA__ACR15491
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggccgcaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcaucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94298 - RNA, 1698 nt, Artificial Sequence
  derived and/or modified sequence opt2 from hemagglutinin__InfluenzaA__ACR15502
augaaggucaagcuccucguccuccucugcaccuucaccgccaccuacgccgacaccaucugcaucggcuaccacgccaacaacgccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94299 - RNA, 1698 nt, Artificial Sequence; identical to SEQ ID NO: 94155
  derived and/or modified sequence opt2 from hemagglutinin__InfluenzaA__ACR15513

SEQ ID NO: 94300 - RNA, 1701 nt, Artificial Sequence
  derived and/or modified sequence opt2 from hemagglutinin__InfluenzaA__ACR15524
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaaguccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94301 - RNA, 1701 nt, Artificial Sequence; identical to SEQ ID NO: 94109
  derived and/or modified sequence opt2 from hemagglutinin__InfluenzaA__ACR15535

SEQ ID NO: 94302 - RNA, 1701 nt, Artificial Sequence
  derived and/or modified sequence opt2 from hemagglutinin__InfluenzaA__ACR15546
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccacauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94303 - RNA, 1701 nt, Artificial Sequence; identical to SEQ ID NO: 93884
  derived and/or modified sequence opt2 from hemagglutinin__InfluenzaA__ACR15557

SEQ ID NO: 94304 - RNA, 1701 nt, Artificial Sequence; identical to SEQ ID NO: 92142
  derived and/or modified sequence opt2 from hemagglutinin__InfluenzaA__ACR15568

SEQ ID NO: 94305 - RNA, 1701 nt, Artificial Sequence
  derived and/or modified sequence opt2 from hemagglutinin__InfluenzaA__ACR15579
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaaccccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94306 - RNA, 1701 nt, Artificial Sequence
  derived and/or modified sequence opt2 from hemagglutinin__InfluenzaA__ACR15590
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94307 - RNA, 1701 nt, Artificial Sequence; identical to SEQ ID NO: 92142
  derived and/or modified sequence opt2 from hemagglutinin__InfluenzaA__ACR15601

SEQ ID NO: 94308 - RNA, 1701 nt, Artificial Sequence
  derived and/or modified sequence opt2 from hemagglutinin__InfluenzaA__ACR18920
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94309 - RNA, 1701 nt, Artificial Sequence; identical to SEQ ID NO: 94181
  derived and/or modified sequence opt2 from hemagglutinin__InfluenzaA__ACR18975

SEQ ID NO: 94310 - RNA, 1701 nt, Artificial Sequence; identical to SEQ ID NO: 94168
  derived and/or modified sequence opt2 from hemagglutinin__InfluenzaA__ACR18976

SEQ ID NO: 94311 - RNA, 1701 nt, Artificial Sequence; identical to SEQ ID NO: 94168
  derived and/or modified sequence opt2 from hemagglutinin__InfluenzaA__ACR18977

SEQ ID NO: 94312 - RNA, 1701 nt, Artificial Sequence; identical to SEQ ID NO: 94181
  derived and/or modified sequence opt2 from hemagglutinin__InfluenzaA__ACR18978

SEQ ID NO: 94313 - RNA, 1701 nt, Artificial Sequence; identical to SEQ ID NO: 94168
  derived and/or modified sequence opt2 from hemagglutinin__InfluenzaA__ACR18979

SEQ ID NO: 94314 - RNA, 1701 nt, Artificial Sequence; identical to SEQ ID NO: 94234
  derived and/or modified sequence opt2 from hemagglutinin__InfluenzaA__ACR18981

SEQ ID NO: 94315 - RNA, 1701 nt, Artificial Sequence; identical to SEQ ID NO: 94168
  derived and/or modified sequence opt2 from hemagglutinin__InfluenzaA__ACR18982

SEQ ID NO: 94316 - RNA, 1701 nt, Artificial Sequence; identical to SEQ ID NO: 94181
  derived and/or modified sequence opt2 from hemagglutinin__InfluenzaA__ACR18988

SEQ ID NO: 94317 - RNA, 1701 nt, Artificial Sequence
  derived and/or modified sequence opt2 from hemagglutinin__InfluenzaA__ACR18991
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaaccgcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94318 - RNA, 1701 nt, Artificial Sequence; identical to SEQ ID NO: 94168
  derived and/or modified sequence opt2 from hemagglutinin__InfluenzaA__ACR18993

SEQ ID NO: 94319 - RNA, 1701 nt, Artificial Sequence; identical to SEQ ID NO: 94207
  derived and/or modified sequence opt2 from hemagglutinin__InfluenzaA__ACR18995

SEQ ID NO: 94320 - RNA, 1701 nt, Artificial Sequence; identical to SEQ ID NO: 94229
  derived and/or modified sequence opt2 from hemagglutinin__InfluenzaA__ACR23302

SEQ ID NO: 94321 - RNA, 1701 nt, Artificial Sequence; identical to SEQ ID NO: 94181
  derived and/or modified sequence opt2 from hemagglutinin__InfluenzaA__ACR33743

SEQ ID NO: 94322 - RNA, 1701 nt, Artificial Sequence; identical to SEQ ID NO: 94168
  derived and/or modified sequence opt2 from hemagglutinin__InfluenzaA__ACR38821

SEQ ID NO: 94323 - RNA, 1701 nt, Artificial Sequence; identical to SEQ ID NO: 94168
  derived and/or modified sequence opt2 from hemagglutinin__InfluenzaA__ACR38822

SEQ ID NO: 94324 - RNA, 1701 nt, Artificial Sequence; identical to SEQ ID NO: 94168
  derived and/or modified sequence opt2 from hemagglutinin__InfluenzaA__ACR38823

SEQ ID NO: 94325 - RNA, 1701 nt, Artificial Sequence; identical to SEQ ID NO: 94234
  derived and/or modified sequence opt2 from hemagglutinin__InfluenzaA__ACR38824

SEQ ID NO: 94326 - RNA, 1701 nt, Artificial Sequence
  derived and/or modified sequence opt2 from hemagglutinin__InfluenzaA__ACR38825
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94327 - RNA, 1701 nt, Artificial Sequence; identical to SEQ ID NO: 94181
  derived and/or modified sequence opt2 from hemagglutinin__InfluenzaA__ACR38826

SEQ ID NO: 94328 - RNA, 1701 nt, Artificial Sequence; identical to SEQ ID NO: 94168
  derived and/or modified sequence opt2 from hemagglutinin__InfluenzaA__ACR38827

SEQ ID NO: 94329 - RNA, 1701 nt, Artificial Sequence; identical to SEQ ID NO: 94234
  derived and/or modified sequence opt2 from hemagglutinin__InfluenzaA__ACR38828

SEQ ID NO: 94330 - RNA, 1701 nt, Artificial Sequence; identical to SEQ ID NO: 94168
  derived and/or modified sequence opt2 from hemagglutinin__InfluenzaA__ACR38829

SEQ ID NO: 94331 - RNA, 1701 nt, Artificial Sequence; identical to SEQ ID NO: 94207
  derived and/or modified sequence opt2 from hemagglutinin__InfluenzaA__ACR38830

SEQ ID NO: 94332 - RNA, 1701 nt, Artificial Sequence; identical to SEQ ID NO: 94181
  derived and/or modified sequence opt2 from hemagglutinin__InfluenzaA__ACR39354

SEQ ID NO: 94333 - RNA, 1701 nt, Artificial Sequence; identical to SEQ ID NO: 94181
  derived and/or modified sequence opt2 from hemagglutinin__InfluenzaA__ACR39393

SEQ ID NO: 94334 - RNA, 1701 nt, Artificial Sequence; identical to SEQ ID NO: 94181
  derived and/or modified sequence opt2 from hemagglutinin__InfluenzaA__ACR39403

SEQ ID NO: 94335 - RNA, 1701 nt, Artificial Sequence; identical to SEQ ID NO: 94181
  derived and/or modified sequence opt2 from hemagglutinin__InfluenzaA__ACR39413

SEQ ID NO: 94336 - RNA, 1701 nt, Artificial Sequence; identical to SEQ ID NO: 94181
  derived and/or modified sequence opt2 from hemagglutinin__InfluenzaA__ACR39423

SEQ ID NO: 94337 - RNA, 1701 nt, Artificial Sequence; identical to SEQ ID NO: 94181
  derived and/or modified sequence opt2 from hemagglutinin__InfluenzaA__ACR39433

SEQ ID NO: 94338 - RNA, 1701 nt, Artificial Sequence; identical to SEQ ID NO: 94181
  derived and/or modified sequence opt2 from hemagglutinin__InfluenzaA__ACR39443

SEQ ID NO: 94339 - RNA, 1701 nt, Artificial Sequence
  derived and/or modified sequence opt2 from hemagglutinin__InfluenzaA__ACR39453
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94340 - RNA, 1701 nt, Artificial Sequence; identical to SEQ ID NO: 94181
  derived and/or modified sequence opt2 from hemagglutinin__InfluenzaA__ACR39463

SEQ ID NO: 94341 - RNA, 1701 nt, Artificial Sequence; identical to SEQ ID NO: 94181
  derived and/or modified sequence opt2 from hemagglutinin__InfluenzaA__ACR39473

SEQ ID NO: 94342 - RNA, 1701 nt, Artificial Sequence; identical to SEQ ID NO: 94181
  derived and/or modified sequence opt2 from hemagglutinin__InfluenzaA__ACR39483

SEQ ID NO: 94343 - RNA, 1701 nt, Artificial Sequence; identical to SEQ ID NO: 94181
  derived and/or modified sequence opt2 from hemagglutinin__InfluenzaA__ACR39493

SEQ ID NO: 94344 - RNA, 1701 nt, Artificial Sequence; identical to SEQ ID NO: 94181
  derived and/or modified sequence opt2 from hemagglutinin__InfluenzaA__ACR40288

SEQ ID NO: 94345 - RNA, 1701 nt, Artificial Sequence; identical to SEQ ID NO: 94181
  derived and/or modified sequence opt2 from hemagglutinin__InfluenzaA__ACR40298

SEQ ID NO: 94346 - RNA, 1701 nt, Artificial Sequence
  derived and/or modified sequence opt2 from hemagglutinin__InfluenzaA__ACR40308
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacaucuaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94347 - RNA, 1701 nt, Artificial Sequence; identical to SEQ ID NO: 94181
  derived and/or modified sequence opt2 from hemagglutinin__InfluenzaA__ACR40318

SEQ ID NO: 94348 - RNA, 1701 nt, Artificial Sequence; identical to SEQ ID NO: 94181
  derived and/or modified sequence opt2 from hemagglutinin__InfluenzaA__ACR40328

SEQ ID NO: 94349 - RNA, 1701 nt, Artificial Sequence; identical to SEQ ID NO: 94181
  derived and/or modified sequence opt2 from hemagglutinin__InfluenzaA__ACR40338

SEQ ID NO: 94350 - RNA, 1701 nt, Artificial Sequence; identical to SEQ ID NO: 94181
  derived and/or modified sequence opt2 from hemagglutinin__InfluenzaA__ACR40348

SEQ ID NO: 94351 - RNA, 1701 nt, Artificial Sequence; identical to SEQ ID NO: 94181
  derived and/or modified sequence opt2 from hemagglutinin__InfluenzaA__ACR40358

SEQ ID NO: 94352 - RNA, 1701 nt, Artificial Sequence; identical to SEQ ID NO: 94181
  derived and/or modified sequence opt2 from hemagglutinin__InfluenzaA__ACR40378

SEQ ID NO: 94353 - RNA, 1701 nt, Artificial Sequence; identical to SEQ ID NO: 94181
  derived and/or modified sequence opt2 from hemagglutinin__InfluenzaA__ACR40388

SEQ ID NO: 94354 - RNA, 1701 nt, Artificial Sequence; identical to SEQ ID NO: 94168
  derived and/or modified sequence opt2 from hemagglutinin__InfluenzaA__ACR46986

SEQ ID NO: 94355 - RNA, 1701 nt, Artificial Sequence; identical to SEQ ID NO: 94168
  derived and/or modified sequence opt2 from hemagglutinin__InfluenzaA__ACR46988

SEQ ID NO: 94356 - RNA, 1701 nt, Artificial Sequence; identical to SEQ ID NO: 94168
  derived and/or modified sequence opt2 from hemagglutinin__InfluenzaA__ACR46989

SEQ ID NO: 94357 - RNA, 1701 nt, Artificial Sequence; identical to SEQ ID NO: 94168
  derived and/or modified sequence opt2 from hemagglutinin__InfluenzaA__ACR46990

SEQ ID NO: 94358 - RNA, 1701 nt, Artificial Sequence; identical to SEQ ID NO: 94168
  derived and/or modified sequence opt2 from hemagglutinin__InfluenzaA__ACR46992

SEQ ID NO: 94359 - RNA, 1701 nt, Artificial Sequence; identical to SEQ ID NO: 94168
  derived and/or modified sequence opt2 from hemagglutinin__InfluenzaA__ACR46993

SEQ ID NO: 94360 - RNA, 1701 nt, Artificial Sequence; identical to SEQ ID NO: 94168
  derived and/or modified sequence opt2 from hemagglutinin__InfluenzaA__ACR46994

SEQ ID NO: 94361 - RNA, 1701 nt, Artificial Sequence
  derived and/or modified sequence opt2 from hemagglutinin__InfluenzaA__ACR47006
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94362 - RNA, 1701 nt, Artificial Sequence; identical to SEQ ID NO: 94181
  derived and/or modified sequence opt2 from hemagglutinin__InfluenzaA__ACR49281

SEQ ID NO: 94363 - RNA, 1701 nt, Artificial Sequence
  derived and/or modified sequence opt2 from hemagglutinin__InfluenzaA__ACR49282
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94364 - RNA, 1701 nt, Artificial Sequence; identical to SEQ ID NO: 94168
  derived and/or modified sequence opt2 from hemagglutinin__InfluenzaA__ACR49283

SEQ ID NO: 94365 - RNA, 1701 nt, Artificial Sequence; identical to SEQ ID NO: 94168
  derived and/or modified sequence opt2 from hemagglutinin__InfluenzaA__ACR49288

SEQ ID NO: 94366 - RNA, 1701 nt, Artificial Sequence; identical to SEQ ID NO: 94207
  derived and/or modified sequence opt2 from hemagglutinin__InfluenzaA__ACR49290

SEQ ID NO: 94367 - RNA, 1701 nt, Artificial Sequence; identical to SEQ ID NO: 94181
  derived and/or modified sequence opt2 from hemagglutinin__InfluenzaA__ACR49291

SEQ ID NO: 94368 - RNA, 1701 nt, Artificial Sequence; identical to SEQ ID NO: 94207
  derived and/or modified sequence opt2 from hemagglutinin__InfluenzaA__ACR49293

SEQ ID NO: 94369 - RNA, 1701 nt, Artificial Sequence; identical to SEQ ID NO: 94207
  derived and/or modified sequence opt2 from hemagglutinin__InfluenzaA__ACR49295

SEQ ID NO: 94370 - RNA, 1701 nt, Artificial Sequence; identical to SEQ ID NO: 94221
  derived and/or modified sequence opt2 from hemagglutinin__InfluenzaA__ACR50993

SEQ ID NO: 94371 - RNA, 1701 nt, Artificial Sequence; identical to SEQ ID NO: 94181
  derived and/or modified sequence opt2 from hemagglutinin__InfluenzaA__ACR50995

SEQ ID NO: 94372 - RNA, 1701 nt, Artificial Sequence; identical to SEQ ID NO: 94181
  derived and/or modified sequence opt2 from hemagglutinin__InfluenzaA__ACR51005

SEQ ID NO: 94373 - RNA, 1701 nt, Artificial Sequence; identical to SEQ ID NO: 94181
  derived and/or modified sequence opt2 from hemagglutinin__InfluenzaA__ACR51015

SEQ ID NO: 94374 - RNA, 1701 nt, Artificial Sequence; identical to SEQ ID NO: 94181
  derived and/or modified sequence opt2 from hemagglutinin__InfluenzaA__ACR51025

SEQ ID NO: 94375 - RNA, 1701 nt, Artificial Sequence; identical to SEQ ID NO: 94181
  derived and/or modified sequence opt2 from hemagglutinin__InfluenzaA__ACR51035

SEQ ID NO: 94376 - RNA, 1701 nt, Artificial Sequence; identical to SEQ ID NO: 94181
  derived and/or modified sequence opt2 from hemagglutinin__InfluenzaA__ACR51045

SEQ ID NO: 94377 - RNA, 1701 nt, Artificial Sequence; identical to SEQ ID NO: 94181
  derived and/or modified sequence opt2 from hemagglutinin__InfluenzaA__ACR51055

SEQ ID NO: 94378 - RNA, 1701 nt, Artificial Sequence; identical to SEQ ID NO: 94168
  derived and/or modified sequence opt2 from hemagglutinin__InfluenzaA__ACR51065

SEQ ID NO: 94379 - RNA, 1701 nt, Artificial Sequence; identical to SEQ ID NO: 94181
  derived and/or modified sequence opt2 from hemagglutinin__InfluenzaA__ACR52368

SEQ ID NO: 94380 - RNA, 1701 nt, Artificial Sequence; identical to SEQ ID NO: 94181
  derived and/or modified sequence opt2 from hemagglutinin__InfluenzaA__ACR52378

SEQ ID NO: 94381 - RNA, 1701 nt, Artificial Sequence; identical to SEQ ID NO: 94181
  derived and/or modified sequence opt2 from hemagglutinin__InfluenzaA__ACR52398

SEQ ID NO: 94382 - RNA, 1701 nt, Artificial Sequence; identical to SEQ ID NO: 94181
  derived and/or modified sequence opt2 from hemagglutinin__InfluenzaA__ACR52408

SEQ ID NO: 94383 - RNA, 1701 nt, Artificial Sequence; identical to SEQ ID NO: 94181
  derived and/or modified sequence opt2 from hemagglutinin__InfluenzaA__ACR52418

SEQ ID NO: 94384 - RNA, 1701 nt, Artificial Sequence; identical to SEQ ID NO: 94181
  derived and/or modified sequence opt2 from hemagglutinin__InfluenzaA__ACR52428

SEQ ID NO: 94385 - RNA, 1701 nt, Artificial Sequence; identical to SEQ ID NO: 94181
  derived and/or modified sequence opt2 from hemagglutinin__InfluenzaA__ACR52438

SEQ ID NO: 94386 - RNA, 1701 nt, Artificial Sequence; identical to SEQ ID NO: 94181
  derived and/or modified sequence opt2 from hemagglutinin__InfluenzaA__ACR52448

SEQ ID NO: 94387 - RNA, 1701 nt, Artificial Sequence; identical to SEQ ID NO: 94181
  derived and/or modified sequence opt2 from hemagglutinin__InfluenzaA__ACR52458

SEQ ID NO: 94388 - RNA, 1701 nt, Artificial Sequence; identical to SEQ ID NO: 94181
  derived and/or modified sequence opt2 from hemagglutinin__InfluenzaA__ACR52468

SEQ ID NO: 94389 - RNA, 1701 nt, Artificial Sequence; identical to SEQ ID NO: 94181
  derived and/or modified sequence opt2 from hemagglutinin__InfluenzaA__ACR52478

SEQ ID NO: 94390 - RNA, 1701 nt, Artificial Sequence; identical to SEQ ID NO: 94181
  derived and/or modified sequence opt2 from hemagglutinin__InfluenzaA__ACR52488

SEQ ID NO: 94391 - RNA, 1701 nt, Artificial Sequence; identical to SEQ ID NO: 94181
  derived and/or modified sequence opt2 from hemagglutinin__InfluenzaA__ACR54045

SEQ ID NO: 94392 - RNA, 1701 nt, Artificial Sequence
  derived and/or modified sequence opt2 from hemagglutinin__InfluenzaA__ACR54047
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94393 - RNA, 1701 nt, Artificial Sequence
  derived and/or modified sequence opt2 from hemagglutinin__InfluenzaA__ACR54964
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaucgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94394 - RNA, 1701 nt, Artificial Sequence; identical to SEQ ID NO: 94272
  derived and/or modified sequence opt2 from hemagglutinin__InfluenzaA__ACR54974

SEQ ID NO: 94395 - RNA, 1701 nt, Artificial Sequence; identical to SEQ ID NO: 94181
  derived and/or modified sequence opt2 from hemagglutinin__InfluenzaA__ACR54984

SEQ ID NO: 94396 - RNA, 1701 nt, Artificial Sequence; identical to SEQ ID NO: 94168
  derived and/or modified sequence opt2 from hemagglutinin__InfluenzaA__ACR54994

SEQ ID NO: 94397 - RNA, 1701 nt, Artificial Sequence; identical to SEQ ID NO: 94168
  derived and/or modified sequence opt2 from hemagglutinin__InfluenzaA__ACR55004

SEQ ID NO: 94398 - RNA, 1701 nt, Artificial Sequence; identical to SEQ ID NO: 94361
  derived and/or modified sequence opt2 from hemagglutinin__InfluenzaA__ACR56380

SEQ ID NO: 94399 - RNA, 1701 nt, Artificial Sequence; identical to SEQ ID NO: 94234
  derived and/or modified sequence opt2 from hemagglutinin__InfluenzaA__ACR56390

SEQ ID NO: 94400 - RNA, 1701 nt, Artificial Sequence; identical to SEQ ID NO: 94181
  derived and/or modified sequence opt2 from hemagglutinin__InfluenzaA__ACR56400

SEQ ID NO: 94401 - RNA, 1701 nt, Artificial Sequence; identical to SEQ ID NO: 94181
  derived and/or modified sequence opt2 from hemagglutinin__InfluenzaA__ACR56410

SEQ ID NO: 94402 - RNA, 1701 nt, Artificial Sequence; identical to SEQ ID NO: 94181
  derived and/or modified sequence opt2 from hemagglutinin__InfluenzaA__ACR56420

SEQ ID NO: 94403 - RNA, 1701 nt, Artificial Sequence; identical to SEQ ID NO: 94181
  derived and/or modified sequence opt2 from hemagglutinin__InfluenzaA__ACR56430

SEQ ID NO: 94404 - RNA, 1701 nt, Artificial Sequence; identical to SEQ ID NO: 94181
  derived and/or modified sequence opt2 from hemagglutinin__InfluenzaA__ACR56440

SEQ ID NO: 94405 - RNA, 1698 nt, Artificial Sequence
  derived and/or modified sequence opt2 from hemagglutinin__InfluenzaA__ACR58541
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucacccgcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgacaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94406 - RNA, 1698 nt, Artificial Sequence; identical to SEQ ID NO: 93426
  derived and/or modified sequence opt2 from hemagglutinin__InfluenzaA__ACR61655

SEQ ID NO: 94407 - RNA, 1698 nt, Artificial Sequence; identical to SEQ ID NO: 93442
  derived and/or modified sequence opt2 from hemagglutinin__InfluenzaA__ACR61666

SEQ ID NO: 94408 - RNA, 1701 nt, Artificial Sequence; identical to SEQ ID NO: 93946
  derived and/or modified sequence opt2 from hemagglutinin__InfluenzaA__ACR61677

SEQ ID NO: 94409 - RNA, 1701 nt, Artificial Sequence; identical to SEQ ID NO: 93946
  derived and/or modified sequence opt2 from hemagglutinin__InfluenzaA__ACR61688

SEQ ID NO: 94410 - RNA, 1701 nt, Artificial Sequence; identical to SEQ ID NO: 93946
  derived and/or modified sequence opt2 from hemagglutinin__InfluenzaA__ACR61699

SEQ ID NO: 94411 - RNA, 1701 nt, Artificial Sequence; identical to SEQ ID NO: 94168
  derived and/or modified sequence opt2 from hemagglutinin__InfluenzaA__ACR67170

SEQ ID NO: 94412 - RNA, 1701 nt, Artificial Sequence; identical to SEQ ID NO: 94207
  derived and/or modified sequence opt2 from hemagglutinin__InfluenzaA__ACR67171

SEQ ID NO: 94413 - RNA, 1701 nt, Artificial Sequence; identical to SEQ ID NO: 94168
  derived and/or modified sequence opt2 from hemagglutinin__InfluenzaA__ACR67172

SEQ ID NO: 94414 - RNA, 1701 nt, Artificial Sequence; identical to SEQ ID NO: 94168
  derived and/or modified sequence opt2 from hemagglutinin__InfluenzaA__ACR67177

SEQ ID NO: 94415 - RNA, 1701 nt, Artificial Sequence; identical to SEQ ID NO: 94168
  derived and/or modified sequence opt2 from hemagglutinin__InfluenzaA__ACR67181

SEQ ID NO: 94416 - RNA, 1701 nt, Artificial Sequence
  derived and/or modified sequence opt2 from hemagglutinin__InfluenzaA__ACR67183
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94417 - RNA, 1701 nt, Artificial Sequence; identical to SEQ ID NO: 94181
  derived and/or modified sequence opt2 from hemagglutinin__InfluenzaA__ACR67184

SEQ ID NO: 94418 - RNA, 1701 nt, Artificial Sequence; identical to SEQ ID NO: 94168
  derived and/or modified sequence opt2 from hemagglutinin__InfluenzaA__ACR67185

SEQ ID NO: 94419 - RNA, 1701 nt, Artificial Sequence; identical to SEQ ID NO: 94361
  derived and/or modified sequence opt2 from hemagglutinin__InfluenzaA__ACR67186

SEQ ID NO: 94420 - RNA, 1701 nt, Artificial Sequence; identical to SEQ ID NO: 94168
  derived and/or modified sequence opt2 from hemagglutinin__InfluenzaA__ACR67187

SEQ ID NO: 94421 - RNA, 1701 nt, Artificial Sequence; identical to SEQ ID NO: 94207
  derived and/or modified sequence opt2 from hemagglutinin__InfluenzaA__ACR67188

SEQ ID NO: 94422 - RNA, 1701 nt, Artificial Sequence; identical to SEQ ID NO: 94207
  derived and/or modified sequence opt2 from hemagglutinin__InfluenzaA__ACR67189

SEQ ID NO: 94423 - RNA, 1701 nt, Artificial Sequence
  derived and/or modified sequence opt2 from hemagglutinin__InfluenzaA__ACR67190
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94424 - RNA, 1701 nt, Artificial Sequence; identical to SEQ ID NO: 94168
  derived and/or modified sequence opt2 from hemagglutinin__InfluenzaA__ACR67192

SEQ ID NO: 94425 - RNA, 1701 nt, Artificial Sequence
  derived and/or modified sequence opt2 from hemagglutinin__InfluenzaA__ACR67193
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgagugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94426 - RNA, 1701 nt, Artificial Sequence; identical to SEQ ID NO: 94168
  derived and/or modified sequence opt2 from hemagglutinin__InfluenzaA__ACR67195

SEQ ID NO: 94427 - RNA, 1701 nt, Artificial Sequence; identical to SEQ ID NO: 94168
  derived and/or modified sequence opt2 from hemagglutinin__InfluenzaA__ACR67197

SEQ ID NO: 94428 - RNA, 1701 nt, Artificial Sequence; identical to SEQ ID NO: 94425
  derived and/or modified sequence opt2 from hemagglutinin__InfluenzaA__ACR67198

SEQ ID NO: 94429 - RNA, 1701 nt, Artificial Sequence; identical to SEQ ID NO: 94168
  derived and/or modified sequence opt2 from hemagglutinin__InfluenzaA__ACR67199

SEQ ID NO: 94430 - RNA, 1701 nt, Artificial Sequence; identical to SEQ ID NO: 94181
  derived and/or modified sequence opt2 from hemagglutinin__InfluenzaA__ACR67244

SEQ ID NO: 94431 - RNA, 1701 nt, Artificial Sequence
  derived and/or modified sequence opt2 from hemagglutinin__InfluenzaA__ACR67254
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgucggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94432 - RNA, 1701 nt, Artificial Sequence; identical to SEQ ID NO: 94181
  derived and/or modified sequence opt2 from hemagglutinin__InfluenzaA__ACR77438

SEQ ID NO: 94433 - RNA, 1701 nt, Artificial Sequence; identical to SEQ ID NO: 94181
  derived and/or modified sequence opt2 from hemagglutinin__InfluenzaA__ACR77448

SEQ ID NO: 94434 - RNA, 1701 nt, Artificial Sequence
  derived and/or modified sequence opt2 from hemagglutinin__InfluenzaA__ACR77458
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucgacaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94435 - RNA, 1701 nt, Artificial Sequence; identical to SEQ ID NO: 94181
  derived and/or modified sequence opt2 from hemagglutinin__InfluenzaA__ACR77468

SEQ ID NO: 94436 - RNA, 1701 nt, Artificial Sequence; identical to SEQ ID NO: 94181
  derived and/or modified sequence opt2 from hemagglutinin__InfluenzaA__ACR77478

SEQ ID NO: 94437 - RNA, 1701 nt, Artificial Sequence; identical to SEQ ID NO: 94181
  derived and/or modified sequence opt2 from hemagglutinin__InfluenzaA__ACR77488

SEQ ID NO: 94438 - RNA, 1701 nt, Artificial Sequence; identical to SEQ ID NO: 94181
  derived and/or modified sequence opt2 from hemagglutinin__InfluenzaA__ACR77498

SEQ ID NO: 94439 - RNA, 1701 nt, Artificial Sequence; identical to SEQ ID NO: 94168
  derived and/or modified sequence opt2 from hemagglutinin__InfluenzaA__ACR83525

SEQ ID NO: 94440 - RNA, 1701 nt, Artificial Sequence
  derived and/or modified sequence opt2 from hemagglutinin__InfluenzaA__ACR83538
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccucucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94441 - RNA, 1701 nt, Artificial Sequence; identical to SEQ ID NO: 94181
  derived and/or modified sequence opt2 from hemagglutinin__InfluenzaA__ACS14666

SEQ ID NO: 94442 - RNA, 1701 nt, Artificial Sequence; identical to SEQ ID NO: 94181
  derived and/or modified sequence opt2 from hemagglutinin__InfluenzaA__ACS14676

SEQ ID NO: 94443 - RNA, 1701 nt, Artificial Sequence; identical to SEQ ID NO: 94181
  derived and/or modified sequence opt2 from hemagglutinin__InfluenzaA__ACS14686

SEQ ID NO: 94444 - RNA, 1701 nt, Artificial Sequence; identical to SEQ ID NO: 94181
  derived and/or modified sequence opt2 from hemagglutinin__InfluenzaA__ACS14696

SEQ ID NO: 94445 - RNA, 1701 nt, Artificial Sequence; identical to SEQ ID NO: 94181
  derived and/or modified sequence opt2 from hemagglutinin__InfluenzaA__ACS14706

SEQ ID NO: 94446 - RNA, 1701 nt, Artificial Sequence; identical to SEQ ID NO: 94181
  derived and/or modified sequence opt2 from hemagglutinin__InfluenzaA__ACS14716

SEQ ID NO: 94447 - RNA, 1701 nt, Artificial Sequence; identical to SEQ ID NO: 94181
  derived and/or modified sequence opt2 from hemagglutinin__InfluenzaA__ACS14726

SEQ ID NO: 94448 - RNA, 1701 nt, Artificial Sequence; identical to SEQ ID NO: 94181
  derived and/or modified sequence opt2 from hemagglutinin__InfluenzaA__ACS14736

SEQ ID NO: 94449 - RNA, 1701 nt, Artificial Sequence; identical to SEQ ID NO: 94361
  derived and/or modified sequence opt2 from hemagglutinin__InfluenzaA__ACS27189

SEQ ID NO: 94450 - RNA, 1701 nt, Artificial Sequence; identical to SEQ ID NO: 94181
  derived and/or modified sequence opt2 from hemagglutinin__InfluenzaA__ACS27199

SEQ ID NO: 94451 - RNA, 1701 nt, Artificial Sequence; identical to SEQ ID NO: 94181
  derived and/or modified sequence opt2 from hemagglutinin__InfluenzaA__ACS27209

SEQ ID NO: 94452 - RNA, 1701 nt, Artificial Sequence; identical to SEQ ID NO: 94234
  derived and/or modified sequence opt2 from hemagglutinin__InfluenzaA__ACS27219

SEQ ID NO: 94453 - RNA, 1701 nt, Artificial Sequence; identical to SEQ ID NO: 94181
  derived and/or modified sequence opt2 from hemagglutinin__InfluenzaA__ACS27229

SEQ ID NO: 94454 - RNA, 1701 nt, Artificial Sequence
  derived and/or modified sequence opt2 from hemagglutinin__InfluenzaA__ACS27239
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccauguccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94455 - RNA, 1701 nt, Artificial Sequence; identical to SEQ ID NO: 94181
  derived and/or modified sequence opt2 from hemagglutinin__InfluenzaA__ACS27249

SEQ ID NO: 94456 - RNA, 1701 nt, Artificial Sequence; identical to SEQ ID NO: 94181
  derived and/or modified sequence opt2 from hemagglutinin__InfluenzaA__ACS27775

SEQ ID NO: 94457 - RNA, 1701 nt, Artificial Sequence; identical to SEQ ID NO: 94168
  derived and/or modified sequence opt2 from hemagglutinin__InfluenzaA__ACS34705

SEQ ID NO: 94458 - RNA, 1701 nt, Artificial Sequence; identical to SEQ ID NO: 94168
  derived and/or modified sequence opt2 from hemagglutinin__InfluenzaA__ACS34966

SEQ ID NO: 94459 - RNA, 1701 nt, Artificial Sequence
  derived and/or modified sequence opt2 from hemagglutinin__InfluenzaA__ACS34967
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagucccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaaggccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94460 - RNA, 1701 nt, Artificial Sequence
  derived and/or modified sequence opt2 from hemagglutinin__InfluenzaA__ACS34968
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgaguccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaucuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94461 - RNA, 1701 nt, Artificial Sequence
  derived and/or modified sequence opt2 from hemagglutinin__InfluenzaA__ACS36632
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaaggccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94462 - RNA, 1701 nt, Artificial Sequence
  derived and/or modified sequence opt2 from hemagglutinin__InfluenzaA__ACS36645
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcaccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaaguccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94463 - RNA, 1701 nt, Artificial Sequence
  derived and/or modified sequence opt2 from hemagglutinin__InfluenzaA__ACS45035
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacaccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94464 - RNA, 1701 nt, Artificial Sequence; identical to SEQ ID NO: 94181
  derived and/or modified sequence opt2 from hemagglutinin__InfluenzaA__ACS50084

SEQ ID NO: 94465 - RNA, 1701 nt, Artificial Sequence; identical to SEQ ID NO: 94423
  derived and/or modified sequence opt2 from hemagglutinin__InfluenzaA__ACS50095

SEQ ID NO: 94466 - RNA, 1701 nt, Artificial Sequence
  derived and/or modified sequence opt2 from hemagglutinin__InfluenzaA__ACS54258
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacuacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94467 - RNA, 1701 nt, Artificial Sequence; identical to SEQ ID NO: 94196
  derived and/or modified sequence opt2 from hemagglutinin__InfluenzaA__ACS54259

SEQ ID NO: 94468 - RNA, 1701 nt, Artificial Sequence; identical to SEQ ID NO: 94168
  derived and/or modified sequence opt2 from hemagglutinin__InfluenzaA__ACS54260

SEQ ID NO: 94469 - RNA, 1701 nt, Artificial Sequence; identical to SEQ ID NO: 94181
  derived and/or modified sequence opt2 from hemagglutinin__InfluenzaA__ACS54261

SEQ ID NO: 94470 - RNA, 1701 nt, Artificial Sequence; identical to SEQ ID NO: 94181
  derived and/or modified sequence opt2 from hemagglutinin__InfluenzaA__ACS54263

SEQ ID NO: 94471 - RNA, 1701 nt, Artificial Sequence; identical to SEQ ID NO: 94181
  derived and/or modified sequence opt2 from hemagglutinin__InfluenzaA__ACS54301

SEQ ID NO: 94472 - RNA, 1701 nt, Artificial Sequence; identical to SEQ ID NO: 94168
  derived and/or modified sequence opt2 from hemagglutinin__InfluenzaA__ACS66821

SEQ ID NO: 94473 - RNA, 1701 nt, Artificial Sequence
  derived and/or modified sequence opt2 from hemagglutinin__InfluenzaA__ACS68822
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgagggccuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94474 - RNA, 1701 nt, Artificial Sequence; identical to SEQ ID NO: 94181
  derived and/or modified sequence opt2 from hemagglutinin__InfluenzaA__ACS75821

SEQ ID NO: 94475 - RNA, 1701 nt, Artificial Sequence; identical to SEQ ID NO: 94181
  derived and/or modified sequence opt2 from hemagglutinin__InfluenzaA__ACS77926

SEQ ID NO: 94476 - RNA, 1701 nt, Artificial Sequence; identical to SEQ ID NO: 94181
  derived and/or modified sequence opt2 from hemagglutinin__InfluenzaA__ACS77936

SEQ ID NO: 94477 - RNA, 1701 nt, Artificial Sequence; identical to SEQ ID NO: 94274
  derived and/or modified sequence opt2 from hemagglutinin__InfluenzaA__ACS77946

SEQ ID NO: 94478 - RNA, 1701 nt, Artificial Sequence; identical to SEQ ID NO: 94181
  derived and/or modified sequence opt2 from hemagglutinin__InfluenzaA__ACS77956

SEQ ID NO: 94479 - RNA, 1701 nt, Artificial Sequence; identical to SEQ ID NO: 94181
  derived and/or modified sequence opt2 from hemagglutinin__InfluenzaA__ACS77966

SEQ ID NO: 94480 - RNA, 1701 nt, Artificial Sequence; identical to SEQ ID NO: 94181
  derived and/or modified sequence opt2 from hemagglutinin__InfluenzaA__ACS77976

SEQ ID NO: 94481 - RNA, 1701 nt, Artificial Sequence; identical to SEQ ID NO: 94423
  derived and/or modified sequence opt2 from hemagglutinin__InfluenzaA__ACS77986

SEQ ID NO: 94482 - RNA, 1701 nt, Artificial Sequence
  derived and/or modified sequence opt2 from hemagglutinin__InfluenzaA__ACS77996
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94483 - RNA, 1701 nt, Artificial Sequence; identical to SEQ ID NO: 94181
  derived and/or modified sequence opt2 from hemagglutinin__InfluenzaA__ACS78006

SEQ ID NO: 94484 - RNA, 1701 nt, Artificial Sequence; identical to SEQ ID NO: 94181
  derived and/or modified sequence opt2 from hemagglutinin__InfluenzaA__ACS78016

SEQ ID NO: 94485 - RNA, 1701 nt, Artificial Sequence
  derived and/or modified sequence opt2 from hemagglutinin__InfluenzaA__ACS78026
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaucuccuccuggcccaaccacgacuccaaccgcggcgucaccgccgccugcccccacgccggcgccaaguccuucuacaagaaccucaucuggcucgucaagaagggcaacuccuaccccaagcucaucaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94486 - RNA, 1701 nt, Artificial Sequence; identical to SEQ ID NO: 94423
  derived and/or modified sequence opt2 from hemagglutinin__InfluenzaA__ACS78036

SEQ ID NO: 94487 - RNA, 1701 nt, Artificial Sequence; identical to SEQ ID NO: 94423
  derived and/or modified sequence opt2 from hemagglutinin__InfluenzaA__ACS78046

SEQ ID NO: 94488 - RNA, 1701 nt, Artificial Sequence; identical to SEQ ID NO: 94196
  derived and/or modified sequence opt2 from hemagglutinin__InfluenzaA__ACS92569

SEQ ID NO: 94489 - RNA, 1701 nt, Artificial Sequence; identical to SEQ ID NO: 94196
  derived and/or modified sequence opt2 from hemagglutinin__InfluenzaA__ACS92579

SEQ ID NO: 94490 - RNA, 1701 nt, Artificial Sequence; identical to SEQ ID NO: 94181
  derived and/or modified sequence opt2 from hemagglutinin__InfluenzaA__ACS92589

SEQ ID NO: 94491 - RNA, 1701 nt, Artificial Sequence
  derived and/or modified sequence opt2 from hemagglutinin__InfluenzaA__ACS92612
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccauccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcgacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94492 - RNA, 1701 nt, Artificial Sequence; identical to SEQ ID NO: 94181
  derived and/or modified sequence opt2 from hemagglutinin__InfluenzaA__ACT10307

SEQ ID NO: 94493 - RNA, 1701 nt, Artificial Sequence; identical to SEQ ID NO: 94181
  derived and/or modified sequence opt2 from hemagglutinin__InfluenzaA__ACT10314

SEQ ID NO: 94494 - RNA, 1701 nt, Artificial Sequence
  derived and/or modified sequence opt2 from hemagglutinin__InfluenzaA__ACT11057
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94495 - RNA, 1704 nt, Artificial Sequence
  derived and/or modified sequence opt2 from hemagglutinin__InfluenzaA__ACT15312
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94496 - RNA, 1704 nt, Artificial Sequence
  derived and/or modified sequence opt2 from hemagglutinin__InfluenzaA__ACT15314
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucaccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94497 - RNA, 1704 nt, Artificial Sequence
  derived and/or modified sequence opt2 from hemagglutinin__InfluenzaA__ACT15316
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucauccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94498 - RNA, 1704 nt, Artificial Sequence
  derived and/or modified sequence opt2 from hemagglutinin__InfluenzaA__ACT15320
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcauguccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94499 - RNA, 1704 nt, Artificial Sequence
  derived and/or modified sequence opt2 from hemagglutinin__InfluenzaA__ACT15322
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagucccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94500 - RNA, 1704 nt, Artificial Sequence
  derived and/or modified sequence opt2 from hemagglutinin__InfluenzaA__ACT15326
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucauccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94501 - RNA, 1704 nt, Artificial Sequence
  derived and/or modified sequence opt2 from hemagglutinin__InfluenzaA__ACT15328
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccagaacggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccacuacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94502 - RNA, 1704 nt, Artificial Sequence
  derived and/or modified sequence opt2 from hemagglutinin__InfluenzaA__ACT15330
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccacuacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94503 - RNA, 1707 nt, Artificial Sequence
  derived and/or modified sequence opt2 from hemagglutinin__InfluenzaA__ACT15332
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccacaaccccaccaccuacaucuccgucggcaccuccacccucaaccagcgccucguccccaagaucgccacccgcuccaagaucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcaagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucuuccucuggaugugcuccaacggcucccuccagugccgcaucugcaucuga

SEQ ID NO: 94504 - RNA, 1704 nt, Artificial Sequence
  derived and/or modified sequence opt2 from hemagglutinin__InfluenzaA__ACT15336
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94505 - RNA, 1704 nt, Artificial Sequence
  derived and/or modified sequence opt2 from hemagglutinin__InfluenzaA__ACT15338
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagcgcuccuacaacaacaccaaccaggaggaccuccucguccucuggggcauccaccaccccaacgacgccaccgagcagacccgccucuaccagaaccccaccaccuacaucuccgucggcaccuccacccucaaccagcgccucauccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccaggagggccgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94506 - RNA, 1704 nt, Artificial Sequence
  derived and/or modified sequence opt2 from hemagglutinin__InfluenzaA__ACT15340
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagcgcuccuacaacaacaccaaccaggaggaccuccucguccucuggggcauccaccaccccaacgacgccgaggagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacgcccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94507 - RNA, 1704 nt, Artificial Sequence
  derived and/or modified sequence opt2 from hemagglutinin__InfluenzaA__ACT15342
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcuccuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucauccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94508 - RNA, 1704 nt, Artificial Sequence; identical to SEQ ID NO: 94504
  derived and/or modified sequence opt2 from hemagglutinin__InfluenzaA__ACT15343

SEQ ID NO: 94509 - RNA, 1704 nt, Artificial Sequence
  derived and/or modified sequence opt2 from hemagglutinin__InfluenzaA__ACT15345
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccuccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucggcuccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94510 - RNA, 1707 nt, Artificial Sequence
  derived and/or modified sequence opt2 from hemagglutinin__InfluenzaA__ACT15347
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccacaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcaagaaccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucuuccucuggaugugcuccaacggcucccuccagugccgcaucugcaucuga

SEQ ID NO: 94511 - RNA, 1704 nt, Artificial Sequence
  derived and/or modified sequence opt2 from hemagglutinin__InfluenzaA__ACT15349
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccaccgagcagacccgccucuaccagaaccccaccaccuacaucuccgucggcaccuccacccucaaccagcgccucauccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccaggaggagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94512 - RNA, 1707 nt, Artificial Sequence
  derived and/or modified sequence opt2 from hemagglutinin__InfluenzaA__ACT15351
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgaccacgaggccuccuccggcgucuccuccgccugccccuaccagggcggcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccacaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcaagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaagcucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucuuccucuggaugugcuccaacggcucccuccagugccgcaucugcaucuga

SEQ ID NO: 94513 - RNA, 1704 nt, Artificial Sequence
  derived and/or modified sequence opt2 from hemagglutinin__InfluenzaA__ACT15353
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacuccgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94514 - RNA, 1707 nt, Artificial Sequence
  derived and/or modified sequence opt2 from hemagglutinin__InfluenzaA__ACT15355
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccacaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcaagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucuuccucuggaugugcuccaacggcucccuccagugccgcaucugcaucuga

SEQ ID NO: 94515 - RNA, 1704 nt, Artificial Sequence
  derived and/or modified sequence opt2 from hemagglutinin__InfluenzaA__ACT15357
auggagaagaucguccuccuccucgccaucgucucccucgucaaguccgaccagaucugcaucggcuaccacgccaacaacuccaccgagcaggucgacaccaucauggagcgcaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucacccagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucauccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 94516 - RNA, 1701 nt, Artificial Sequence
  derived and/or modified sequence opt2 from hemagglutinin__InfluenzaA__ACT20200
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94517 - RNA, 1701 nt, Artificial Sequence
  derived and/or modified sequence opt2 from hemagglutinin__InfluenzaA__ACT21466
augaagaccaucaucgcccucuccuacauccucugccucgucuucgcccagaagcuccccggcaacgacaacuccaccgccacccccugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94518 - RNA, 1701 nt, Artificial Sequence
  derived and/or modified sequence opt2 from hemagglutinin__InfluenzaA__ACT21467
augaagaccaucaucgcccucuccuacauccucugccucgucuucgcccagaagcuccccggcuccgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccgucuacuggaccaucgucaagccccgcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccgcaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94519 - RNA, 1701 nt, Artificial Sequence
  derived and/or modified sequence opt2 from hemagglutinin__InfluenzaA__ACT21468
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgucgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94520 - RNA, 1701 nt, Artificial Sequence
  derived and/or modified sequence opt2 from hemagglutinin__InfluenzaA__ACT21469
augaagaccaucaucgcccucuccuacaucucccgccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccaggacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94521 - RNA, 1701 nt, Artificial Sequence
  derived and/or modified sequence opt2 from hemagglutinin__InfluenzaA__ACT21471
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccaggacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94522 - RNA, 1701 nt, Artificial Sequence
  derived and/or modified sequence opt2 from hemagglutinin__InfluenzaA__ACT21472
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccaggacggcaccuccuacgccugcaagcgccgcuccaucaaguccuucuucuccacccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94523 - RNA, 1701 nt, Artificial Sequence
  derived and/or modified sequence opt2 from hemagglutinin__InfluenzaA__ACT21507
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaaccgcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagggccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacacccgcaucgaccucugguccuacaacgccgagcuccucgucgcccucgagucccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaagcgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94524 - RNA, 1701 nt, Artificial Sequence
  derived and/or modified sequence opt2 from hemagglutinin__InfluenzaA__ACT21508
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaggacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94525 - RNA, 1701 nt, Artificial Sequence
  derived and/or modified sequence opt2 from hemagglutinin__InfluenzaA__ACT21509
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcccaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94526 - RNA, 1701 nt, Artificial Sequence
  derived and/or modified sequence opt2 from hemagglutinin__InfluenzaA__ACT21510
augaagaccaucaucgcccucuccuacauccucugccccgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccaggacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccgagaagcagcuccgcgagaacgccgaggacaugggcaacggcugcuucaagaucuaccacaagugcgacaacgccggcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94527 - RNA, 1701 nt, Artificial Sequence; identical to SEQ ID NO: 94425
  derived and/or modified sequence opt2 from hemagglutinin__InfluenzaA__ACT21572

SEQ ID NO: 94528 - RNA, 1701 nt, Artificial Sequence; identical to SEQ ID NO: 94181
  derived and/or modified sequence opt2 from hemagglutinin__InfluenzaA__ACT22031

SEQ ID NO: 94529 - RNA, 1701 nt, Artificial Sequence; identical to SEQ ID NO: 94181
  derived and/or modified sequence opt2 from hemagglutinin__InfluenzaA__ACT22032

SEQ ID NO: 94530 - RNA, 1701 nt, Artificial Sequence; identical to SEQ ID NO: 94181
  derived and/or modified sequence opt2 from hemagglutinin__InfluenzaA__ACT22033

SEQ ID NO: 94531 - RNA, 1701 nt, Artificial Sequence; identical to SEQ ID NO: 94181
  derived and/or modified sequence opt2 from hemagglutinin__InfluenzaA__ACT22034

SEQ ID NO: 94532 - RNA, 1701 nt, Artificial Sequence; identical to SEQ ID NO: 94196
  derived and/or modified sequence opt2 from hemagglutinin__InfluenzaA__ACT22035

SEQ ID NO: 94533 - RNA, 1701 nt, Artificial Sequence
  derived and/or modified sequence opt2 from hemagglutinin__InfluenzaA__ACT22036
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94534 - RNA, 1701 nt, Artificial Sequence
  derived and/or modified sequence opt2 from hemagglutinin__InfluenzaA__ACT22037
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94535 - RNA, 1701 nt, Artificial Sequence
  derived and/or modified sequence opt2 from hemagglutinin__InfluenzaA__ACT22038
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94536 - RNA, 1701 nt, Artificial Sequence
  derived and/or modified sequence opt2 from hemagglutinin__InfluenzaA__ACT22055
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgcaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94537 - RNA, 1701 nt, Artificial Sequence; identical to SEQ ID NO: 94494
  derived and/or modified sequence opt2 from hemagglutinin__InfluenzaA__ACT22504

SEQ ID NO: 94538 - RNA, 1701 nt, Artificial Sequence; identical to SEQ ID NO: 94423
  derived and/or modified sequence opt2 from hemagglutinin__InfluenzaA__ACT33122

SEQ ID NO: 94539 - RNA, 1701 nt, Artificial Sequence
  derived and/or modified sequence opt2 from hemagglutinin__InfluenzaA__ACT33123
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccaguuccgcaucugcaucuga

SEQ ID NO: 94540 - RNA, 1701 nt, Artificial Sequence; identical to SEQ ID NO: 94181
  derived and/or modified sequence opt2 from hemagglutinin__InfluenzaA__ACT33125

SEQ ID NO: 94541 - RNA, 1701 nt, Artificial Sequence
  derived and/or modified sequence opt2 from hemagglutinin__InfluenzaA__ACT36505
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94542 - RNA, 1701 nt, Artificial Sequence
  derived and/or modified sequence opt2 from hemagglutinin__InfluenzaA__ACT36649
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgcccgcuccugguccuacaucgucgagaccuccuccuccgacaacggcaccugcuaccccggcgacuucaucgacuacgaggagcuccgcgagcagcucaacuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagucccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94543 - RNA, 1701 nt, Artificial Sequence; identical to SEQ ID NO: 94181
  derived and/or modified sequence opt2 from hemagglutinin__InfluenzaA__ACT36650

SEQ ID NO: 94544 - RNA, 1701 nt, Artificial Sequence; identical to SEQ ID NO: 94181
  derived and/or modified sequence opt2 from hemagglutinin__InfluenzaA__ACT36652

SEQ ID NO: 94545 - RNA, 1701 nt, Artificial Sequence; identical to SEQ ID NO: 94179
  derived and/or modified sequence opt2 from hemagglutinin__InfluenzaA__ACT36653

SEQ ID NO: 94546 - RNA, 1701 nt, Artificial Sequence
  derived and/or modified sequence opt2 from hemagglutinin__InfluenzaA__ACT36655
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94547 - RNA, 1701 nt, Artificial Sequence; identical to SEQ ID NO: 94168
  derived and/or modified sequence opt2 from hemagglutinin__InfluenzaA__ACT36658

SEQ ID NO: 94548 - RNA, 1701 nt, Artificial Sequence; identical to SEQ ID NO: 94207
  derived and/or modified sequence opt2 from hemagglutinin__InfluenzaA__ACT36659

SEQ ID NO: 94549 - RNA, 1701 nt, Artificial Sequence; identical to SEQ ID NO: 94168
  derived and/or modified sequence opt2 from hemagglutinin__InfluenzaA__ACT36661

SEQ ID NO: 94550 - RNA, 1701 nt, Artificial Sequence; identical to SEQ ID NO: 94181
  derived and/or modified sequence opt2 from hemagglutinin__InfluenzaA__ACT36663

SEQ ID NO: 94551 - RNA, 1701 nt, Artificial Sequence; identical to SEQ ID NO: 94181
  derived and/or modified sequence opt2 from hemagglutinin__InfluenzaA__ACT36666

SEQ ID NO: 94552 - RNA, 1701 nt, Artificial Sequence
  derived and/or modified sequence opt2 from hemagglutinin__InfluenzaA__ACT52687
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcuucuaccagauccucgccaucuacuccaccgucgccuccucccucguccucgucgucucccucggcgccaucuccuucuggaugugcuccaacggcucccuccagugccgcaucugcaucuga

SEQ ID NO: 94553 - RNA, 1701 nt, Artificial Sequence; identical to SEQ ID NO: 94168
  derived and/or modified sequence opt2 from hemagglutinin__InfluenzaA__ACT54606

SEQ ID NO: 94554 - RNA, 1701 nt, Artificial Sequence; identical to SEQ ID NO: 94181
  derived and/or modified sequence opt2 from hemagglutinin__InfluenzaA__ACT66146

SEQ ID NO: 94555 - RNA, 1701 nt, Artificial Sequence; identical to SEQ ID NO: 94423
  derived and/or modified sequence opt2 from hemagglutinin__InfluenzaA__ACT66155

SEQ ID NO: 94556 - RNA, 1701 nt, Artificial Sequence
  derived and/or modified sequence opt2 from hemagglutinin__InfluenzaA__ACT66162
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcaccucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94557 - RNA, 1701 nt, Artificial Sequence; identical to SEQ ID NO: 94181
  derived and/or modified sequence opt2 from hemagglutinin__InfluenzaA__ACT67239

SEQ ID NO: 94558 - RNA, 1701 nt, Artificial Sequence; identical to SEQ ID NO: 94181
  derived and/or modified sequence opt2 from hemagglutinin__InfluenzaA__ACT67255

SEQ ID NO: 94559 - RNA, 1701 nt, Artificial Sequence; identical to SEQ ID NO: 94168
  derived and/or modified sequence opt2 from hemagglutinin__InfluenzaA__ACT68102

SEQ ID NO: 94560 - RNA, 1701 nt, Artificial Sequence
  derived and/or modified sequence opt2 from hemagglutinin__InfluenzaA__ACT68103
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccucaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94561 - RNA, 1701 nt, Artificial Sequence; identical to SEQ ID NO: 94168
  derived and/or modified sequence opt2 from hemagglutinin__InfluenzaA__ACT68104

SEQ ID NO: 94562 - RNA, 1701 nt, Artificial Sequence
  derived and/or modified sequence opt2 from hemagglutinin__InfluenzaA__ACT68105
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccggcgaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94563 - RNA, 1701 nt, Artificial Sequence; identical to SEQ ID NO: 94168
  derived and/or modified sequence opt2 from hemagglutinin__InfluenzaA__ACT68106

SEQ ID NO: 94564 - RNA, 1701 nt, Artificial Sequence; identical to SEQ ID NO: 94168
  derived and/or modified sequence opt2 from hemagglutinin__InfluenzaA__ACT68107

SEQ ID NO: 94565 - RNA, 1701 nt, Artificial Sequence; identical to SEQ ID NO: 94361
  derived and/or modified sequence opt2 from hemagglutinin__InfluenzaA__ACT68108

SEQ ID NO: 94566 - RNA, 1701 nt, Artificial Sequence
  derived and/or modified sequence opt2 from hemagglutinin__InfluenzaA__ACT68109
augaaggccauccucgucguccuccucuacaccuucgccaccgccaacaccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94567 - RNA, 1701 nt, Artificial Sequence; identical to SEQ ID NO: 94168
  derived and/or modified sequence opt2 from hemagglutinin__InfluenzaA__ACT68110

SEQ ID NO: 94568 - RNA, 1701 nt, Artificial Sequence; identical to SEQ ID NO: 94168
  derived and/or modified sequence opt2 from hemagglutinin__InfluenzaA__ACT68112

SEQ ID NO: 94569 - RNA, 1701 nt, Artificial Sequence; identical to SEQ ID NO: 94168
  derived and/or modified sequence opt2 from hemagglutinin__InfluenzaA__ACT68113

SEQ ID NO: 94570 - RNA, 1701 nt, Artificial Sequence; identical to SEQ ID NO: 94168
  derived and/or modified sequence opt2 from hemagglutinin__InfluenzaA__ACT68115

SEQ ID NO: 94571 - RNA, 1701 nt, Artificial Sequence; identical to SEQ ID NO: 94168
  derived and/or modified sequence opt2 from hemagglutinin__InfluenzaA__ACT68119

SEQ ID NO: 94572 - RNA, 1701 nt, Artificial Sequence
  derived and/or modified sequence opt2 from hemagglutinin__InfluenzaA__ACT79133
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggaagcucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94573 - RNA, 1701 nt, Artificial Sequence; identical to SEQ ID NO: 94168
  derived and/or modified sequence opt2 from hemagglutinin__InfluenzaA__ACT79143

SEQ ID NO: 94574 - RNA, 1701 nt, Artificial Sequence; identical to SEQ ID NO: 94207
  derived and/or modified sequence opt2 from hemagglutinin__InfluenzaA__ACT79153

SEQ ID NO: 94575 - RNA, 1701 nt, Artificial Sequence; identical to SEQ ID NO: 94494
  derived and/or modified sequence opt2 from hemagglutinin__InfluenzaA__ACT79163

SEQ ID NO: 94576 - RNA, 1701 nt, Artificial Sequence; identical to SEQ ID NO: 94494
  derived and/or modified sequence opt2 from hemagglutinin__InfluenzaA__ACT79173

SEQ ID NO: 94577 - RNA, 1701 nt, Artificial Sequence
  derived and/or modified sequence opt2 from hemagglutinin__InfluenzaA__ACT79625
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucaagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94578 - RNA, 1701 nt, Artificial Sequence; identical to SEQ ID NO: 94168
  derived and/or modified sequence opt2 from hemagglutinin__InfluenzaA__ACT79627

SEQ ID NO: 94579 - RNA, 1701 nt, Artificial Sequence
  derived and/or modified sequence opt2 from hemagglutinin__InfluenzaA__ACT82512
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccaguucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94580 - RNA, 1701 nt, Artificial Sequence; identical to SEQ ID NO: 94181
  derived and/or modified sequence opt2 from hemagglutinin__InfluenzaA__ACT82513

SEQ ID NO: 94581 - RNA, 1701 nt, Artificial Sequence
  derived and/or modified sequence opt2 from hemagglutinin__InfluenzaA__ACT82514
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccaacacccccguccacgacugcaacaccaccugccagacccccaagggcuccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94582 - RNA, 1701 nt, Artificial Sequence; identical to SEQ ID NO: 94181
  derived and/or modified sequence opt2 from hemagglutinin__InfluenzaA__ACT82515

SEQ ID NO: 94583 - RNA, 1701 nt, Artificial Sequence
  derived and/or modified sequence opt2 from hemagglutinin__InfluenzaA__ACT82516
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94584 - RNA, 1701 nt, Artificial Sequence; identical to SEQ ID NO: 94423
  derived and/or modified sequence opt2 from hemagglutinin__InfluenzaA__ACT83795

SEQ ID NO: 94585 - RNA, 1701 nt, Artificial Sequence; identical to SEQ ID NO: 94423
  derived and/or modified sequence opt2 from hemagglutinin__InfluenzaA__ACT83805

SEQ ID NO: 94586 - RNA, 1701 nt, Artificial Sequence; identical to SEQ ID NO: 94181
  derived and/or modified sequence opt2 from hemagglutinin__InfluenzaA__ACT83815

SEQ ID NO: 94587 - RNA, 1701 nt, Artificial Sequence; identical to SEQ ID NO: 94181
  derived and/or modified sequence opt2 from hemagglutinin__InfluenzaA__ACT83825

SEQ ID NO: 94588 - RNA, 1701 nt, Artificial Sequence; identical to SEQ ID NO: 94181
  derived and/or modified sequence opt2 from hemagglutinin__InfluenzaA__ACT83835

SEQ ID NO: 94589 - RNA, 1701 nt, Artificial Sequence; identical to SEQ ID NO: 94274
  derived and/or modified sequence opt2 from hemagglutinin__InfluenzaA__ACT83845

SEQ ID NO: 94590 - RNA, 1701 nt, Artificial Sequence; identical to SEQ ID NO: 94168
  derived and/or modified sequence opt2 from hemagglutinin__InfluenzaA__ACT83855

SEQ ID NO: 94591 - RNA, 1701 nt, Artificial Sequence; identical to SEQ ID NO: 94181
  derived and/or modified sequence opt2 from hemagglutinin__InfluenzaA__ACT83865

SEQ ID NO: 94592 - RNA, 1701 nt, Artificial Sequence; identical to SEQ ID NO: 94423
  derived and/or modified sequence opt2 from hemagglutinin__InfluenzaA__ACT83875

SEQ ID NO: 94593 - RNA, 1701 nt, Artificial Sequence; identical to SEQ ID NO: 94423
  derived and/or modified sequence opt2 from hemagglutinin__InfluenzaA__ACT85999

SEQ ID NO: 94594 - RNA, 1701 nt, Artificial Sequence; identical to SEQ ID NO: 94423
  derived and/or modified sequence opt2 from hemagglutinin__InfluenzaA__ACT86009

SEQ ID NO: 94595 - RNA, 1701 nt, Artificial Sequence; identical to SEQ ID NO: 94181
  derived and/or modified sequence opt2 from hemagglutinin__InfluenzaA__ACT86019

SEQ ID NO: 94596 - RNA, 1701 nt, Artificial Sequence; identical to SEQ ID NO: 94274
  derived and/or modified sequence opt2 from hemagglutinin__InfluenzaA__ACT86029

SEQ ID NO: 94597 - RNA, 1701 nt, Artificial Sequence; identical to SEQ ID NO: 94181
  derived and/or modified sequence opt2 from hemagglutinin__InfluenzaA__ACT86039

SEQ ID NO: 94598 - RNA, 1701 nt, Artificial Sequence; identical to SEQ ID NO: 94181
  derived and/or modified sequence opt2 from hemagglutinin__InfluenzaA__ACT86059

SEQ ID NO: 94599 - RNA, 1701 nt, Artificial Sequence; identical to SEQ ID NO: 94181
  derived and/or modified sequence opt2 from hemagglutinin__InfluenzaA__ACT86069

SEQ ID NO: 94600 - RNA, 1701 nt, Artificial Sequence; identical to SEQ ID NO: 94181
  derived and/or modified sequence opt2 from hemagglutinin__InfluenzaA__ACT86079

SEQ ID NO: 94601 - RNA, 1701 nt, Artificial Sequence; identical to SEQ ID NO: 94181
  derived and/or modified sequence opt2 from hemagglutinin__InfluenzaA__ACT86089

SEQ ID NO: 94602 - RNA, 1701 nt, Artificial Sequence; identical to SEQ ID NO: 94181
  derived and/or modified sequence opt2 from hemagglutinin__InfluenzaA__ACT86099

SEQ ID NO: 94603 - RNA, 1701 nt, Artificial Sequence; identical to SEQ ID NO: 94423
  derived and/or modified sequence opt2 from hemagglutinin__InfluenzaA__ACT86109

SEQ ID NO: 94604 - RNA, 1701 nt, Artificial Sequence; identical to SEQ ID NO: 94181
  derived and/or modified sequence opt2 from hemagglutinin__InfluenzaA__ACT86119

SEQ ID NO: 94605 - RNA, 1701 nt, Artificial Sequence; identical to SEQ ID NO: 94423
  derived and/or modified sequence opt2 from hemagglutinin__InfluenzaA__ACT86129

SEQ ID NO: 94606 - RNA, 1701 nt, Artificial Sequence; identical to SEQ ID NO: 94181
  derived and/or modified sequence opt2 from hemagglutinin__InfluenzaA__ACT86139

SEQ ID NO: 94607 - RNA, 1701 nt, Artificial Sequence
  derived and/or modified sequence opt2 from hemagglutinin__InfluenzaA__ACU00932
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaacuucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94608 - RNA, 1701 nt, Artificial Sequence; identical to SEQ ID NO: 94181
  derived and/or modified sequence opt2 from hemagglutinin__InfluenzaA__ACU00942

SEQ ID NO: 94609 - RNA, 1701 nt, Artificial Sequence; identical to SEQ ID NO: 94181
  derived and/or modified sequence opt2 from hemagglutinin__InfluenzaA__ACU00952

SEQ ID NO: 94610 - RNA, 1701 nt, Artificial Sequence
  derived and/or modified sequence opt2 from hemagglutinin__InfluenzaA__ACU12494
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccaucaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94611 - RNA, 1698 nt, Artificial Sequence; identical to SEQ ID NO: 94293
  derived and/or modified sequence opt2 from hemagglutinin__InfluenzaA__ACU12505

SEQ ID NO: 94612 - RNA, 1701 nt, Artificial Sequence
  derived and/or modified sequence opt2 from hemagglutinin__InfluenzaA__ACU12516
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucgucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94613 - RNA, 1701 nt, Artificial Sequence; identical to SEQ ID NO: 92142
  derived and/or modified sequence opt2 from hemagglutinin__InfluenzaA__ACU12527

SEQ ID NO: 94614 - RNA, 1701 nt, Artificial Sequence; identical to SEQ ID NO: 93884
  derived and/or modified sequence opt2 from hemagglutinin__InfluenzaA__ACU12538

SEQ ID NO: 94615 - RNA, 1701 nt, Artificial Sequence; identical to SEQ ID NO: 93080
  derived and/or modified sequence opt2 from hemagglutinin__InfluenzaA__ACU12549

SEQ ID NO: 94616 - RNA, 1698 nt, Artificial Sequence
  derived and/or modified sequence opt2 from hemagglutinin__InfluenzaA__ACU12560
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacguccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94617 - RNA, 1698 nt, Artificial Sequence; identical to SEQ ID NO: 94000
  derived and/or modified sequence opt2 from hemagglutinin__InfluenzaA__ACU12571

SEQ ID NO: 94618 - RNA, 1698 nt, Artificial Sequence
  derived and/or modified sequence opt2 from hemagglutinin__InfluenzaA__ACU12582
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccgcuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaagggcaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94619 - RNA, 1698 nt, Artificial Sequence
  derived and/or modified sequence opt2 from hemagglutinin__InfluenzaA__ACU12593
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcaucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94620 - RNA, 1701 nt, Artificial Sequence; identical to SEQ ID NO: 94181
  derived and/or modified sequence opt2 from hemagglutinin__InfluenzaA__ACU13090

SEQ ID NO: 94621 - RNA, 1701 nt, Artificial Sequence; identical to SEQ ID NO: 94181
  derived and/or modified sequence opt2 from hemagglutinin__InfluenzaA__ACU13091

SEQ ID NO: 94622 - RNA, 1701 nt, Artificial Sequence; identical to SEQ ID NO: 94181
  derived and/or modified sequence opt2 from hemagglutinin__InfluenzaA__ACU13092

SEQ ID NO: 94623 - RNA, 1701 nt, Artificial Sequence; identical to SEQ ID NO: 94181
  derived and/or modified sequence opt2 from hemagglutinin__InfluenzaA__ACU13093

SEQ ID NO: 94624 - RNA, 1701 nt, Artificial Sequence
  derived and/or modified sequence opt2 from hemagglutinin__InfluenzaA__ACU13094
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94625 - RNA, 1701 nt, Artificial Sequence; identical to SEQ ID NO: 94181
  derived and/or modified sequence opt2 from hemagglutinin__InfluenzaA__ACU13095

SEQ ID NO: 94626 - RNA, 1701 nt, Artificial Sequence
  derived and/or modified sequence opt2 from hemagglutinin__InfluenzaA__ACU13096
augaaggccauccucgucguccuccuccacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucacccucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94627 - RNA, 1701 nt, Artificial Sequence; identical to SEQ ID NO: 94181
  derived and/or modified sequence opt2 from hemagglutinin__InfluenzaA__ACU13098

SEQ ID NO: 94628 - RNA, 1701 nt, Artificial Sequence
  derived and/or modified sequence opt2 from hemagglutinin__InfluenzaA__ACU13099
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94629 - RNA, 1701 nt, Artificial Sequence
  derived and/or modified sequence opt2 from hemagglutinin__InfluenzaA__ACU13129
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcgaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94630 - RNA, 1701 nt, Artificial Sequence; identical to SEQ ID NO: 94181
  derived and/or modified sequence opt2 from hemagglutinin__InfluenzaA__ACU16795

SEQ ID NO: 94631 - RNA, 1701 nt, Artificial Sequence; identical to SEQ ID NO: 94181
  derived and/or modified sequence opt2 from hemagglutinin__InfluenzaA__ACU16858

SEQ ID NO: 94632 - RNA, 1701 nt, Artificial Sequence; identical to SEQ ID NO: 94181
  derived and/or modified sequence opt2 from hemagglutinin__InfluenzaA__ACU16930

SEQ ID NO: 94633 - RNA, 1701 nt, Artificial Sequence; identical to SEQ ID NO: 94181
  derived and/or modified sequence opt2 from hemagglutinin__InfluenzaA__ACU16993

SEQ ID NO: 94634 - RNA, 1701 nt, Artificial Sequence; identical to SEQ ID NO: 94181
  derived and/or modified sequence opt2 from hemagglutinin__InfluenzaA__ACU17059

SEQ ID NO: 94635 - RNA, 1701 nt, Artificial Sequence; identical to SEQ ID NO: 94181
  derived and/or modified sequence opt2 from hemagglutinin__InfluenzaA__ACU17126

SEQ ID NO: 94636 - RNA, 1701 nt, Artificial Sequence; identical to SEQ ID NO: 94272
  derived and/or modified sequence opt2 from hemagglutinin__InfluenzaA__ACU17187

SEQ ID NO: 94637 - RNA, 1701 nt, Artificial Sequence; identical to SEQ ID NO: 94181
  derived and/or modified sequence opt2 from hemagglutinin__InfluenzaA__ACU17258

SEQ ID NO: 94638 - RNA, 1701 nt, Artificial Sequence
  derived and/or modified sequence opt2 from hemagglutinin__InfluenzaA__ACU17389
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccgccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94639 - RNA, 1701 nt, Artificial Sequence; identical to SEQ ID NO: 94181
  derived and/or modified sequence opt2 from hemagglutinin__InfluenzaA__ACU17450

SEQ ID NO: 94640 - RNA, 1701 nt, Artificial Sequence; identical to SEQ ID NO: 94181
  derived and/or modified sequence opt2 from hemagglutinin__InfluenzaA__ACU17521

SEQ ID NO: 94641 - RNA, 1701 nt, Artificial Sequence; identical to SEQ ID NO: 94168
  derived and/or modified sequence opt2 from hemagglutinin__InfluenzaA__ACU27041

SEQ ID NO: 94642 - RNA, 1698 nt, Artificial Sequence
  derived and/or modified sequence opt2 from hemagglutinin__InfluenzaA__ACU27406
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagauccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagcgcaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94643 - RNA, 1698 nt, Artificial Sequence
  derived and/or modified sequence opt2 from hemagglutinin__InfluenzaA__ACU27407
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94644 - RNA, 1701 nt, Artificial Sequence; identical to SEQ ID NO: 94168
  derived and/or modified sequence opt2 from hemagglutinin__InfluenzaA__ACU29949

SEQ ID NO: 94645 - RNA, 1701 nt, Artificial Sequence
  derived and/or modified sequence opt2 from hemagglutinin__InfluenzaA__ACU29979
augaaggccauccucgucguccuccucuacaccuucgccgccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94646 - RNA, 1701 nt, Artificial Sequence; identical to SEQ ID NO: 94181
  derived and/or modified sequence opt2 from hemagglutinin__InfluenzaA__ACU29989

SEQ ID NO: 94647 - RNA, 1704 nt, Artificial Sequence
  derived and/or modified sequence opt2 from hemagglutinin__InfluenzaA__ACU29999
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccuccagugccgcaucugcaucuga

SEQ ID NO: 94648 - RNA, 1704 nt, Artificial Sequence
  derived and/or modified sequence opt2 from hemagglutinin__InfluenzaA__ACU30009
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggcuacggcucccuccagugccgcaucugcaucuga

SEQ ID NO: 94649 - RNA, 1701 nt, Artificial Sequence; identical to SEQ ID NO: 94541
  derived and/or modified sequence opt2 from hemagglutinin__InfluenzaA__ACU30019

SEQ ID NO: 94650 - RNA, 1701 nt, Artificial Sequence; identical to SEQ ID NO: 94361
  derived and/or modified sequence opt2 from hemagglutinin__InfluenzaA__ACU30093

SEQ ID NO: 94651 - RNA, 1701 nt, Artificial Sequence
  derived and/or modified sequence opt2 from hemagglutinin__InfluenzaA__ACU30103
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94652 - RNA, 1704 nt, Artificial Sequence
  derived and/or modified sequence opt2 from hemagglutinin__InfluenzaA__ACU30112
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcucccacaugguccuccuccagugccgcaucugcaucuga

SEQ ID NO: 94653 - RNA, 1701 nt, Artificial Sequence
  derived and/or modified sequence opt2 from hemagglutinin__InfluenzaA__ACU30121
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94654 - RNA, 1701 nt, Artificial Sequence; identical to SEQ ID NO: 94274
  derived and/or modified sequence opt2 from hemagglutinin__InfluenzaA__ACU31124

SEQ ID NO: 94655 - RNA, 1701 nt, Artificial Sequence; identical to SEQ ID NO: 94213
  derived and/or modified sequence opt2 from hemagglutinin__InfluenzaA__ACU31143

SEQ ID NO: 94656 - RNA, 1701 nt, Artificial Sequence; identical to SEQ ID NO: 94213
  derived and/or modified sequence opt2 from hemagglutinin__InfluenzaA__ACU31144

SEQ ID NO: 94657 - RNA, 1701 nt, Artificial Sequence; identical to SEQ ID NO: 94213
  derived and/or modified sequence opt2 from hemagglutinin__InfluenzaA__ACU31145

SEQ ID NO: 94658 - RNA, 1701 nt, Artificial Sequence; identical to SEQ ID NO: 94361
  derived and/or modified sequence opt2 from hemagglutinin__InfluenzaA__ACU31146

SEQ ID NO: 94659 - RNA, 1701 nt, Artificial Sequence; identical to SEQ ID NO: 94181
  derived and/or modified sequence opt2 from hemagglutinin__InfluenzaA__ACU31147

SEQ ID NO: 94660 - RNA, 1701 nt, Artificial Sequence
  derived and/or modified sequence opt2 from hemagglutinin__InfluenzaA__ACU31148
augaaggccauccucgucaucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94661 - RNA, 1701 nt, Artificial Sequence; identical to SEQ ID NO: 94168
  derived and/or modified sequence opt2 from hemagglutinin__InfluenzaA__ACU31149

SEQ ID NO: 94662 - RNA, 1701 nt, Artificial Sequence; identical to SEQ ID NO: 94168
  derived and/or modified sequence opt2 from hemagglutinin__InfluenzaA__ACU31150

SEQ ID NO: 94663 - RNA, 1701 nt, Artificial Sequence; identical to SEQ ID NO: 94168
  derived and/or modified sequence opt2 from hemagglutinin__InfluenzaA__ACU31151

SEQ ID NO: 94664 - RNA, 1701 nt, Artificial Sequence; identical to SEQ ID NO: 94168
  derived and/or modified sequence opt2 from hemagglutinin__InfluenzaA__ACU31152

SEQ ID NO: 94665 - RNA, 1707 nt, Artificial Sequence
  derived and/or modified sequence opt2 from hemagglutinin__InfluenzaA__ACU46644
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcggcaagccccucauccuccgcgacugccgcgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucugguggauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccaccacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaaccaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacgacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 94666 - RNA, 1701 nt, Artificial Sequence
  derived and/or modified sequence opt2 from hemagglutinin__InfluenzaA__ACU56924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94667 - RNA, 1701 nt, Artificial Sequence; identical to SEQ ID NO: 94534
  derived and/or modified sequence opt2 from hemagglutinin__InfluenzaA__ACU56931

SEQ ID NO: 94668 - RNA, 1701 nt, Artificial Sequence; identical to SEQ ID NO: 94181
  derived and/or modified sequence opt2 from hemagglutinin__InfluenzaA__ACU64792

SEQ ID NO: 94669 - RNA, 1701 nt, Artificial Sequence; identical to SEQ ID NO: 94361
  derived and/or modified sequence opt2 from hemagglutinin__InfluenzaA__ACU64801

SEQ ID NO: 94670 - RNA, 1701 nt, Artificial Sequence; identical to SEQ ID NO: 94361
  derived and/or modified sequence opt2 from hemagglutinin__InfluenzaA__ACU64812

SEQ ID NO: 94671 - RNA, 1701 nt, Artificial Sequence; identical to SEQ ID NO: 93830
  derived and/or modified sequence opt2 from hemagglutinin__InfluenzaA__ACU79871

SEQ ID NO: 94672 - RNA, 1701 nt, Artificial Sequence; identical to SEQ ID NO: 93828
  derived and/or modified sequence opt2 from hemagglutinin__InfluenzaA__ACU79882

SEQ ID NO: 94673 - RNA, 1701 nt, Artificial Sequence; identical to SEQ ID NO: 93841
  derived and/or modified sequence opt2 from hemagglutinin__InfluenzaA__ACU79893

SEQ ID NO: 94674 - RNA, 1701 nt, Artificial Sequence; identical to SEQ ID NO: 93841
  derived and/or modified sequence opt2 from hemagglutinin__InfluenzaA__ACU79904

SEQ ID NO: 94675 - RNA, 1698 nt, Artificial Sequence
  derived and/or modified sequence opt2 from hemagglutinin__InfluenzaA__ACU79937
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucaccgccuccugcucccacaacggcaaguccuccuucuaccgcaaccuccucuggcucaccgagaagaacggccucuaccccaaccucuccaacuccuacgucaacaacaaggagaaggagguccucguccucuggggcguccaccaccccuccaacaucggcguccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugaacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94676 - RNA, 1689 nt, Artificial Sequence
  derived and/or modified sequence opt2 from hemagglutinin__InfluenzaA__ACU79948
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccgacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaacgucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94677 - RNA, 1689 nt, Artificial Sequence
  derived and/or modified sequence opt2 from hemagglutinin__InfluenzaA__ACU79959
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccgacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94678 - RNA, 1701 nt, Artificial Sequence
  derived and/or modified sequence opt2 from hemagglutinin__InfluenzaA__ACU79970
augaagaccaucaucgcccucuccuacauccagugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucuccaagcucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94679 - RNA, 1698 nt, Artificial Sequence
  derived and/or modified sequence opt2 from hemagglutinin__InfluenzaA__ACU79981
augaaggucaagcuccucguccuccucugcaccuucaccgccaccuacgccgacaccaucugcaucggcuaccacgccaacaacuccaccgacaccgucgacaccguccucgagcgcaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucaagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94680 - RNA, 1698 nt, Artificial Sequence
  derived and/or modified sequence opt2 from hemagglutinin__InfluenzaA__ACU79992
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaaggccccccuccagcucggcaacugcuccgucgccggcuggauccucggcaaccccgagugcggccuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94681 - RNA, 1701 nt, Artificial Sequence; identical to SEQ ID NO: 93946
  derived and/or modified sequence opt2 from hemagglutinin__InfluenzaA__ACU80003

SEQ ID NO: 94682 - RNA, 1698 nt, Artificial Sequence
  derived and/or modified sequence opt2 from hemagglutinin__InfluenzaA__ACU80025
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94683 - RNA, 1701 nt, Artificial Sequence
  derived and/or modified sequence opt2 from hemagglutinin__InfluenzaA__ACU80036
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94684 - RNA, 1698 nt, Artificial Sequence; identical to SEQ ID NO: 94155
  derived and/or modified sequence opt2 from hemagglutinin__InfluenzaA__ACU80047

SEQ ID NO: 94685 - RNA, 1701 nt, Artificial Sequence
  derived and/or modified sequence opt2 from hemagglutinin__InfluenzaA__ACU80058
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccugcuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94686 - RNA, 1698 nt, Artificial Sequence; identical to SEQ ID NO: 94000
  derived and/or modified sequence opt2 from hemagglutinin__InfluenzaA__ACU80069

SEQ ID NO: 94687 - RNA, 1698 nt, Artificial Sequence
  derived and/or modified sequence opt2 from hemagglutinin__InfluenzaA__ACU80080
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcaucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94688 - RNA, 1698 nt, Artificial Sequence; identical to SEQ ID NO: 94286
  derived and/or modified sequence opt2 from hemagglutinin__InfluenzaA__ACU80091

SEQ ID NO: 94689 - RNA, 1701 nt, Artificial Sequence; identical to SEQ ID NO: 94049
  derived and/or modified sequence opt2 from hemagglutinin__InfluenzaA__ACU80102

SEQ ID NO: 94690 - RNA, 1701 nt, Artificial Sequence
  derived and/or modified sequence opt2 from hemagglutinin__InfluenzaA__ACU80113
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcaucgcccuccucggcuucaucaugugggccugccagaagggcaacauccgcugcaacaucugcaucuga

SEQ ID NO: 94691 - RNA, 1701 nt, Artificial Sequence
  derived and/or modified sequence opt2 from hemagglutinin__InfluenzaA__ACU80135
augaagaccaucaucgcccucuccuacauccucugccucgucuucgcccagaaguuccccggcaacgacaacuccaccgccacccucugccucggccaccacgccguccccaacggcaccauggucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94692 - RNA, 1701 nt, Artificial Sequence
  derived and/or modified sequence opt2 from hemagglutinin__InfluenzaA__ACU80146
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggccucaucaugugggccugccagaagggcaacauccgcugcaacaucugcaucuga

SEQ ID NO: 94693 - RNA, 1701 nt, Artificial Sequence; identical to SEQ ID NO: 93946
  derived and/or modified sequence opt2 from hemagglutinin__InfluenzaA__ACU80157

SEQ ID NO: 94694 - RNA, 1698 nt, Artificial Sequence; identical to SEQ ID NO: 94682
  derived and/or modified sequence opt2 from hemagglutinin__InfluenzaA__ACU80168

SEQ ID NO: 94695 - RNA, 1701 nt, Artificial Sequence; identical to SEQ ID NO: 93946
  derived and/or modified sequence opt2 from hemagglutinin__InfluenzaA__ACU80179

SEQ ID NO: 94696 - RNA, 1701 nt, Artificial Sequence
  derived and/or modified sequence opt2 from hemagglutinin__InfluenzaA__ACU80190
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94697 - RNA, 1701 nt, Artificial Sequence
  derived and/or modified sequence opt2 from hemagglutinin__InfluenzaA__ACU80201
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 94698 - RNA, 1701 nt, Artificial Sequence; identical to SEQ ID NO: 93946
  derived and/or modified sequence opt2 from hemagglutinin__InfluenzaA__ACU80212

SEQ ID NO: 94699 - RNA, 1698 nt, Artificial Sequence
  derived and/or modified sequence opt2 from hemagglutinin__InfluenzaA__ACU80234
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94700 - RNA, 1701 nt, Artificial Sequence
  derived and/or modified sequence opt2 from hemagglutinin__InfluenzaA__ACU80245
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggccgcugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94701 - RNA, 1701 nt, Artificial Sequence; identical to SEQ ID NO: 94049
  derived and/or modified sequence opt2 from hemagglutinin__InfluenzaA__ACU80256

SEQ ID NO: 94702 - RNA, 1698 nt, Artificial Sequence; identical to SEQ ID NO: 94000
  derived and/or modified sequence opt2 from hemagglutinin__InfluenzaA__ACU80267

SEQ ID NO: 94703 - RNA, 1698 nt, Artificial Sequence; identical to SEQ ID NO: 94682
  derived and/or modified sequence opt2 from hemagglutinin__InfluenzaA__ACU80278

SEQ ID NO: 94704 - RNA, 1701 nt, Artificial Sequence; identical to SEQ ID NO: 93946
  derived and/or modified sequence opt2 from hemagglutinin__InfluenzaA__ACU80289

SEQ ID NO: 94705 - RNA, 1701 nt, Artificial Sequence; identical to SEQ ID NO: 94049
  derived and/or modified sequence opt2 from hemagglutinin__InfluenzaA__ACU80300

SEQ ID NO: 94706 - RNA, 1701 nt, Artificial Sequence
  derived and/or modified sequence opt2 from hemagglutinin__InfluenzaA__ACU80311
augcgcaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94707 - RNA, 1701 nt, Artificial Sequence; identical to SEQ ID NO: 94049
  derived and/or modified sequence opt2 from hemagglutinin__InfluenzaA__ACU80322

SEQ ID NO: 94708 - RNA, 1701 nt, Artificial Sequence; identical to SEQ ID NO: 93946
  derived and/or modified sequence opt2 from hemagglutinin__InfluenzaA__ACU80333

SEQ ID NO: 94709 - RNA, 1701 nt, Artificial Sequence; identical to SEQ ID NO: 94049
  derived and/or modified sequence opt2 from hemagglutinin__InfluenzaA__ACU80344

SEQ ID NO: 94710 - RNA, 1701 nt, Artificial Sequence; identical to SEQ ID NO: 94049
  derived and/or modified sequence opt2 from hemagglutinin__InfluenzaA__ACU80355

SEQ ID NO: 94711 - RNA, 1701 nt, Artificial Sequence; identical to SEQ ID NO: 94049
  derived and/or modified sequence opt2 from hemagglutinin__InfluenzaA__ACU80366

SEQ ID NO: 94712 - RNA, 1701 nt, Artificial Sequence
  derived and/or modified sequence opt2 from hemagglutinin__InfluenzaA__ACU80377
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuucgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcaucgcccuccucggcuucaucaugugggccugccagaagggcaacauccgcugcaacaucugcaucuga

SEQ ID NO: 94713 - RNA, 1701 nt, Artificial Sequence; identical to SEQ ID NO: 94049
  derived and/or modified sequence opt2 from hemagglutinin__InfluenzaA__ACU80388

SEQ ID NO: 94714 - RNA, 1701 nt, Artificial Sequence; identical to SEQ ID NO: 93946
  derived and/or modified sequence opt2 from hemagglutinin__InfluenzaA__ACU80399

SEQ ID NO: 94715 - RNA, 1698 nt, Artificial Sequence
  derived and/or modified sequence opt2 from hemagglutinin__InfluenzaA__ACU80410
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94716 - RNA, 1701 nt, Artificial Sequence
  derived and/or modified sequence opt2 from hemagglutinin__InfluenzaA__ACU80424
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuucgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94717 - RNA, 1701 nt, Artificial Sequence; identical to SEQ ID NO: 94716
  derived and/or modified sequence opt2 from hemagglutinin__InfluenzaA__ACU80435

SEQ ID NO: 94718 - RNA, 1698 nt, Artificial Sequence
  derived and/or modified sequence opt2 from hemagglutinin__InfluenzaA__ACU80446
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucguccuccucgucucccucggcgccaucuccuucuggaugugcuccaacggcucccuccagugccgcaucugcaucuga

SEQ ID NO: 94719 - RNA, 1701 nt, Artificial Sequence; identical to SEQ ID NO: 93946
  derived and/or modified sequence opt2 from hemagglutinin__InfluenzaA__ACU80458

SEQ ID NO: 94720 - RNA, 1701 nt, Artificial Sequence; identical to SEQ ID NO: 93946
  derived and/or modified sequence opt2 from hemagglutinin__InfluenzaA__ACU80470

SEQ ID NO: 94721 - RNA, 1701 nt, Artificial Sequence; identical to SEQ ID NO: 94049
  derived and/or modified sequence opt2 from hemagglutinin__InfluenzaA__ACU80600

SEQ ID NO: 94722 - RNA, 1701 nt, Artificial Sequence; identical to SEQ ID NO: 94716
  derived and/or modified sequence opt2 from hemagglutinin__InfluenzaA__ACU80611

SEQ ID NO: 94723 - RNA, 1701 nt, Artificial Sequence; identical to SEQ ID NO: 94049
  derived and/or modified sequence opt2 from hemagglutinin__InfluenzaA__ACU80622

SEQ ID NO: 94724 - RNA, 1701 nt, Artificial Sequence; identical to SEQ ID NO: 93946
  derived and/or modified sequence opt2 from hemagglutinin__InfluenzaA__ACU80633

SEQ ID NO: 94725 - RNA, 1701 nt, Artificial Sequence
  derived and/or modified sequence opt2 from hemagglutinin__InfluenzaA__ACU80644
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94726 - RNA, 1701 nt, Artificial Sequence; identical to SEQ ID NO: 93946
  derived and/or modified sequence opt2 from hemagglutinin__InfluenzaA__ACU80655

SEQ ID NO: 94727 - RNA, 1701 nt, Artificial Sequence; identical to SEQ ID NO: 93946
  derived and/or modified sequence opt2 from hemagglutinin__InfluenzaA__ACU80666

SEQ ID NO: 94728 - RNA, 1701 nt, Artificial Sequence; identical to SEQ ID NO: 93440
  derived and/or modified sequence opt2 from hemagglutinin__InfluenzaA__ACU80677

SEQ ID NO: 94729 - RNA, 1701 nt, Artificial Sequence; identical to SEQ ID NO: 93946
  derived and/or modified sequence opt2 from hemagglutinin__InfluenzaA__ACU80688

SEQ ID NO: 94730 - RNA, 1701 nt, Artificial Sequence; identical to SEQ ID NO: 94049
  derived and/or modified sequence opt2 from hemagglutinin__InfluenzaA__ACU80699

SEQ ID NO: 94731 - RNA, 1701 nt, Artificial Sequence; identical to SEQ ID NO: 94049
  derived and/or modified sequence opt2 from hemagglutinin__InfluenzaA__ACU80710

SEQ ID NO: 94732 - RNA, 1701 nt, Artificial Sequence
  derived and/or modified sequence opt2 from hemagglutinin__InfluenzaA__ACU80721
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaccgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94733 - RNA, 1701 nt, Artificial Sequence; identical to SEQ ID NO: 93946
  derived and/or modified sequence opt2 from hemagglutinin__InfluenzaA__ACU80732

SEQ ID NO: 94734 - RNA, 1701 nt, Artificial Sequence; identical to SEQ ID NO: 93946
  derived and/or modified sequence opt2 from hemagglutinin__InfluenzaA__ACU80743

SEQ ID NO: 94735 - RNA, 1701 nt, Artificial Sequence
  derived and/or modified sequence opt2 from hemagglutinin__InfluenzaA__ACU80754
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94736 - RNA, 1701 nt, Artificial Sequence
  derived and/or modified sequence opt2 from hemagglutinin__InfluenzaA__ACU80765
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 94737 - RNA, 1701 nt, Artificial Sequence
  derived and/or modified sequence opt2 from hemagglutinin__InfluenzaA__ACU80787
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94738 - RNA, 1701 nt, Artificial Sequence; identical to SEQ ID NO: 93946
  derived and/or modified sequence opt2 from hemagglutinin__InfluenzaA__ACU80798

SEQ ID NO: 94739 - RNA, 1701 nt, Artificial Sequence; identical to SEQ ID NO: 93946
  derived and/or modified sequence opt2 from hemagglutinin__InfluenzaA__ACU81103

SEQ ID NO: 94740 - RNA, 1701 nt, Artificial Sequence
  derived and/or modified sequence opt2 from hemagglutinin__InfluenzaA__ACU87270
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94741 - RNA, 1701 nt, Artificial Sequence; identical to SEQ ID NO: 94181
  derived and/or modified sequence opt2 from hemagglutinin__InfluenzaA__ACV04228

SEQ ID NO: 94742 - RNA, 1701 nt, Artificial Sequence; identical to SEQ ID NO: 94181
  derived and/or modified sequence opt2 from hemagglutinin__InfluenzaA__ACV04238

SEQ ID NO: 94743 - RNA, 1701 nt, Artificial Sequence
  derived and/or modified sequence opt2 from hemagglutinin__InfluenzaA__ACV04248
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94744 - RNA, 1701 nt, Artificial Sequence; identical to SEQ ID NO: 94181
  derived and/or modified sequence opt2 from hemagglutinin__InfluenzaA__ACV04258

SEQ ID NO: 94745 - RNA, 1701 nt, Artificial Sequence; identical to SEQ ID NO: 94181
  derived and/or modified sequence opt2 from hemagglutinin__InfluenzaA__ACV04268

SEQ ID NO: 94746 - RNA, 1701 nt, Artificial Sequence; identical to SEQ ID NO: 94181
  derived and/or modified sequence opt2 from hemagglutinin__InfluenzaA__ACV04278

SEQ ID NO: 94747 - RNA, 1701 nt, Artificial Sequence; identical to SEQ ID NO: 94181
  derived and/or modified sequence opt2 from hemagglutinin__InfluenzaA__ACV04288

SEQ ID NO: 94748 - RNA, 1701 nt, Artificial Sequence
  derived and/or modified sequence opt2 from hemagglutinin__InfluenzaA__ACV04298
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccgucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94749 - RNA, 1701 nt, Artificial Sequence; identical to SEQ ID NO: 94181
  derived and/or modified sequence opt2 from hemagglutinin__InfluenzaA__ACV04308

SEQ ID NO: 94750 - RNA, 1701 nt, Artificial Sequence
  derived and/or modified sequence opt2 from hemagglutinin__InfluenzaA__ACV04318
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94751 - RNA, 1701 nt, Artificial Sequence; identical to SEQ ID NO: 94181
  derived and/or modified sequence opt2 from hemagglutinin__InfluenzaA__ACV04328

SEQ ID NO: 94752 - RNA, 1701 nt, Artificial Sequence; identical to SEQ ID NO: 94181
  derived and/or modified sequence opt2 from hemagglutinin__InfluenzaA__ACV04338

SEQ ID NO: 94753 - RNA, 1701 nt, Artificial Sequence; identical to SEQ ID NO: 94423
  derived and/or modified sequence opt2 from hemagglutinin__InfluenzaA__ACV04358

SEQ ID NO: 94754 - RNA, 1701 nt, Artificial Sequence
  derived and/or modified sequence opt2 from hemagglutinin__InfluenzaA__ACV04368
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94755 - RNA, 1701 nt, Artificial Sequence
  derived and/or modified sequence opt2 from hemagglutinin__InfluenzaA__ACV04378
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 94756 - RNA, 1701 nt, Artificial Sequence; identical to SEQ ID NO: 94423
  derived and/or modified sequence opt2 from hemagglutinin__InfluenzaA__ACV04388

SEQ ID NO: 94757 - RNA, 1701 nt, Artificial Sequence; identical to SEQ ID NO: 94181
  derived and/or modified sequence opt2 from hemagglutinin__InfluenzaA__ACV04398

SEQ ID NO: 94758 - RNA, 1701 nt, Artificial Sequence; identical to SEQ ID NO: 94425
  derived and/or modified sequence opt2 from hemagglutinin__InfluenzaA__ACV04408

SEQ ID NO: 94759 - RNA, 1701 nt, Artificial Sequence; identical to SEQ ID NO: 94181
  derived and/or modified sequence opt2 from hemagglutinin__InfluenzaA__ACV04489

SEQ ID NO: 94760 - RNA, 1701 nt, Artificial Sequence; identical to SEQ ID NO: 94181
  derived and/or modified sequence opt2 from hemagglutinin__InfluenzaA__ACV04499

SEQ ID NO: 94761 - RNA, 1701 nt, Artificial Sequence; identical to SEQ ID NO: 94361
  derived and/or modified sequence opt2 from hemagglutinin__InfluenzaA__ACV04509

SEQ ID NO: 94762 - RNA, 1701 nt, Artificial Sequence; identical to SEQ ID NO: 94181
  derived and/or modified sequence opt2 from hemagglutinin__InfluenzaA__ACV04519

SEQ ID NO: 94763 - RNA, 1701 nt, Artificial Sequence; identical to SEQ ID NO: 94181
  derived and/or modified sequence opt2 from hemagglutinin__InfluenzaA__ACV04529

SEQ ID NO: 94764 - RNA, 1701 nt, Artificial Sequence; identical to SEQ ID NO: 94181
  derived and/or modified sequence opt2 from hemagglutinin__InfluenzaA__ACV04549

SEQ ID NO: 94765 - RNA, 1701 nt, Artificial Sequence; identical to SEQ ID NO: 94181
  derived and/or modified sequence opt2 from hemagglutinin__InfluenzaA__ACV04559

SEQ ID NO: 94766 - RNA, 1701 nt, Artificial Sequence; identical to SEQ ID NO: 94181
  derived and/or modified sequence opt2 from hemagglutinin__InfluenzaA__ACV04579

SEQ ID NO: 94767 - RNA, 1701 nt, Artificial Sequence
  derived and/or modified sequence opt2 from hemagglutinin__InfluenzaA__ACV04751
auggaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccgccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacaccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94768 - RNA, 1701 nt, Artificial Sequence
  derived and/or modified sequence opt2 from hemagglutinin__InfluenzaA__ACV04752
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucgagaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94769 - RNA, 1701 nt, Artificial Sequence
  derived and/or modified sequence opt2 from hemagglutinin__InfluenzaA__ACV04753
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94770 - RNA, 1701 nt, Artificial Sequence
  derived and/or modified sequence opt2 from hemagglutinin__InfluenzaA__ACV04754
auggaggccauccucgucguccuccucuacaccuucgccaccgccaacgccgacacccucugcaucggcuaccacgccaacaacuccaccgacaccgucgacaccguccucgagaagaacguccccgucacccacuccgucaaccuccucaaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggcgucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94771 - RNA, 1701 nt, Artificial Sequence; identical to SEQ ID NO: 94666
  derived and/or modified sequence opt2 from hemagglutinin__InfluenzaA__ACV04755

SEQ ID NO: 94772 - RNA, 1701 nt, Artificial Sequence; identical to SEQ ID NO: 94361
  derived and/or modified sequence opt2 from hemagglutinin__InfluenzaA__ACV33084

SEQ ID NO: 94773 - RNA, 1701 nt, Artificial Sequence; identical to SEQ ID NO: 94181
  derived and/or modified sequence opt2 from hemagglutinin__InfluenzaA__ACV33094

SEQ ID NO: 94774 - RNA, 1701 nt, Artificial Sequence; identical to SEQ ID NO: 94181
  derived and/or modified sequence opt2 from hemagglutinin__InfluenzaA__ACV33104

SEQ ID NO: 94775 - RNA, 1701 nt, Artificial Sequence; identical to SEQ ID NO: 94181
  derived and/or modified sequence opt2 from hemagglutinin__InfluenzaA__ACV33114

SEQ ID NO: 94776 - RNA, 1701 nt, Artificial Sequence; identical to SEQ ID NO: 94181
  derived and/or modified sequence opt2 from hemagglutinin__InfluenzaA__ACV33124

SEQ ID NO: 94777 - RNA, 1701 nt, Artificial Sequence; identical to SEQ ID NO: 94181
  derived and/or modified sequence opt2 from hemagglutinin__InfluenzaA__ACV33134

SEQ ID NO: 94778 - RNA, 1701 nt, Artificial Sequence; identical to SEQ ID NO: 94743
  derived and/or modified sequence opt2 from hemagglutinin__InfluenzaA__ACV33144

SEQ ID NO: 94779 - RNA, 1701 nt, Artificial Sequence; identical to SEQ ID NO: 94181
  derived and/or modified sequence opt2 from hemagglutinin__InfluenzaA__ACV33154

SEQ ID NO: 94780 - RNA, 1701 nt, Artificial Sequence; identical to SEQ ID NO: 94181
  derived and/or modified sequence opt2 from hemagglutinin__InfluenzaA__ACV33164

SEQ ID NO: 94781 - RNA, 1701 nt, Artificial Sequence; identical to SEQ ID NO: 94181
  derived and/or modified sequence opt2 from hemagglutinin__InfluenzaA__ACV33174

SEQ ID NO: 94782 - RNA, 1701 nt, Artificial Sequence; identical to SEQ ID NO: 94168
  derived and/or modified sequence opt2 from hemagglutinin__InfluenzaA__ACV41981

SEQ ID NO: 94783 - RNA, 1701 nt, Artificial Sequence; identical to SEQ ID NO: 94207
  derived and/or modified sequence opt2 from hemagglutinin__InfluenzaA__ACV41991

SEQ ID NO: 94784 - RNA, 1701 nt, Artificial Sequence; identical to SEQ ID NO: 94207
  derived and/or modified sequence opt2 from hemagglutinin__InfluenzaA__ACV42001

SEQ ID NO: 94785 - RNA, 1701 nt, Artificial Sequence; identical to SEQ ID NO: 94181
  derived and/or modified sequence opt2 from hemagglutinin__InfluenzaA__ACV42008

SEQ ID NO: 94786 - RNA, 1701 nt, Artificial Sequence; identical to SEQ ID NO: 94181
  derived and/or modified sequence opt2 from hemagglutinin__InfluenzaA__ACV42018

SEQ ID NO: 94787 - RNA, 1701 nt, Artificial Sequence; identical to SEQ ID NO: 93828
  derived and/or modified sequence opt2 from hemagglutinin__InfluenzaA__ACV49501

SEQ ID NO: 94788 - RNA, 1701 nt, Artificial Sequence
  derived and/or modified sequence opt2 from hemagglutinin__InfluenzaA__ACV49512
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaaggacgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 94789 - RNA, 1701 nt, Artificial Sequence; identical to SEQ ID NO: 93841
  derived and/or modified sequence opt2 from hemagglutinin__InfluenzaA__ACV49523

SEQ ID NO: 94790 - RNA, 1698 nt, Artificial Sequence
  derived and/or modified sequence opt2 from hemagglutinin__InfluenzaA__ACV49545
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 94791 - RNA, 1701 nt, Artificial Sequence
  derived and/or modified sequence opt2 from hemagglutinin__InfluenzaA__ACV49556
augaaggcccgccuccucauccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgacucccuccuccccgccuccuccugguccuacaucgucgagacccccaacuccaagaacggcaucugcuaccccggcgacuucaucgacuacgaggagcuccgcgagcagcucuccuccgucuccuccuucgagcgcuucgagaucuuccccaaggaguccuccuggcccaagcacuccaccaccaagggcgucaccgccgccugcucccacgccggcaaguccuccuucuaccgcaaccuccucuggcucaccaagaaggaggacuccuaccccaagcucuccaacuccuacgucaacaagaagggcaaggagguccucguccucuggggcguccaccaccccuccuccuccaaggagcagcagacccucuaccagaacgagaacgccuacgucuccgucgucuccuccaacuacaaccgccgcuucauccccgagaucgccgagcgccccgaggucaaggaccaggccggccgcaucaacuacuacuggacccuccucgagcccggcgacaccaucaucuucgaggccaacggcaaccucgucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacgucaaguccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagauccagcucaagaacaacgccaaggagaucggcaacggcugcuucgaguucuaccacaagugcgacaacgagugcauggaguccguccgcaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94792 - RNA, 1701 nt, Artificial Sequence
  derived and/or modified sequence opt2 from hemagglutinin__InfluenzaA__ACV49567
augaaggccaagcuccucauccuccucugcgcccucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcgccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccggcaaguccuccuucuacaagaaccuccucuggcucaccgagaccgacggcuccuaccccaagcucuccaaguccuacgucaacaacaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccugguacgccuucgcccucucccgcgacuucggcuccggcaucaucaccuccaacgccuccauggacgagugcgacaccaagugccagaccccccagggcgccaucaacuccucccuccccuuccagaacauccaccccgucaccaucggcgagugccccaaguacgucaaguccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacuggaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94793 - RNA, 1689 nt, Artificial Sequence
  derived and/or modified sequence opt2 from hemagglutinin__InfluenzaA__ACV49578
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaaccccaaguacucccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggccccaacuaccccgucgccaagggcuccuacaacaacaccuccggcgagcagaugcucaucaucuggggcguccaccaccccaucgacgaggccgagcagaucgcccucuaccagaaggucggcaccuacgucuccgccuccaccuccacccucaacaagcgcuccacccccgagaucgccgcccgccccgaggucaacggccucggcucccgcauggaguucuccuggacccuccucgacaugugggacaccaucaacuucgaguccaccggcaaccucgucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94794 - RNA, 1689 nt, Artificial Sequence; identical to SEQ ID NO: 94793
  derived and/or modified sequence opt2 from hemagglutinin__InfluenzaA__ACV49589

SEQ ID NO: 94795 - RNA, 1689 nt, Artificial Sequence
  derived and/or modified sequence opt2 from hemagglutinin__InfluenzaA__ACV49600
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccgagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94796 - RNA, 1689 nt, Artificial Sequence
  derived and/or modified sequence opt2 from hemagglutinin__InfluenzaA__ACV49611
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccgagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccaagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaaggucgaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 94797 - RNA, 1701 nt, Artificial Sequence
  derived and/or modified sequence opt2 from hemagglutinin__InfluenzaA__ACV49633
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccguccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguucccccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 94798 - RNA, 1701 nt, Artificial Sequence; identical to SEQ ID NO: 93868
  derived and/or modified sequence opt2 from hemagglutinin__InfluenzaA__ACV49644

SEQ ID NO: 94799 - RNA, 1698 nt, Artificial Sequence; identical to SEQ ID NO: 94687
  derived and/or modified sequence opt2 from hemagglutinin__InfluenzaA__ACV49676

SEQ ID NO: 94800 - RNA, 1701 nt, Artificial Sequence; identical to SEQ ID NO: 94168
  derived and/or modified sequence opt2 from hemagglutinin__InfluenzaA__ACV53450

SEQ ID NO: 94801 - RNA, 1701 nt, Artificial Sequence; identical to SEQ ID NO: 94168
  derived and/or modified sequence opt2 from hemagglutinin__InfluenzaA__ACV53460

SEQ ID NO: 94802 - RNA, 1701 nt, Artificial Sequence; identical to SEQ ID NO: 94168
  derived and/or modified sequence opt2 from hemagglutinin__InfluenzaA__ACV53480

SEQ ID NO: 94803 - RNA, 1701 nt, Artificial Sequence
  derived and/or modified sequence opt2 from hemagglutinin__InfluenzaA__ACV53490
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagacccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94804 - RNA, 1701 nt, Artificial Sequence
  derived and/or modified sequence opt2 from hemagglutinin__InfluenzaA__ACV53500
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagacccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94805 - RNA, 1701 nt, Artificial Sequence
  derived and/or modified sequence opt2 from hemagglutinin__InfluenzaA__ACV53880
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94806 - RNA, 1701 nt, Artificial Sequence; identical to SEQ ID NO: 94181
  derived and/or modified sequence opt2 from hemagglutinin__InfluenzaA__ACV53881

SEQ ID NO: 94807 - RNA, 1701 nt, Artificial Sequence; identical to SEQ ID NO: 94168
  derived and/or modified sequence opt2 from hemagglutinin__InfluenzaA__ACV53882

SEQ ID NO: 94808 - RNA, 1701 nt, Artificial Sequence; identical to SEQ ID NO: 94181
  derived and/or modified sequence opt2 from hemagglutinin__InfluenzaA__ACV53883

SEQ ID NO: 94809 - RNA, 1701 nt, Artificial Sequence; identical to SEQ ID NO: 94181
  derived and/or modified sequence opt2 from hemagglutinin__InfluenzaA__ACV53885

SEQ ID NO: 94810 - RNA, 1701 nt, Artificial Sequence
  derived and/or modified sequence opt2 from hemagglutinin__InfluenzaA__ACV53899
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94811 - RNA, 1701 nt, Artificial Sequence; identical to SEQ ID NO: 94181
  derived and/or modified sequence opt2 from hemagglutinin__InfluenzaA__ACV53909

SEQ ID NO: 94812 - RNA, 1701 nt, Artificial Sequence; identical to SEQ ID NO: 94181
  derived and/or modified sequence opt2 from hemagglutinin__InfluenzaA__ACV67220

SEQ ID NO: 94813 - RNA, 1701 nt, Artificial Sequence
  derived and/or modified sequence opt2 from hemagglutinin__InfluenzaA__ACV67221
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcggcucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccaguccgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94814 - RNA, 1701 nt, Artificial Sequence; identical to SEQ ID NO: 94168
  derived and/or modified sequence opt2 from hemagglutinin__InfluenzaA__ACV67222

SEQ ID NO: 94815 - RNA, 1701 nt, Artificial Sequence; identical to SEQ ID NO: 94207
  derived and/or modified sequence opt2 from hemagglutinin__InfluenzaA__ACV67223

SEQ ID NO: 94816 - RNA, 1701 nt, Artificial Sequence; identical to SEQ ID NO: 94423
  derived and/or modified sequence opt2 from hemagglutinin__InfluenzaA__ACV67224

SEQ ID NO: 94817 - RNA, 1701 nt, Artificial Sequence; identical to SEQ ID NO: 94361
  derived and/or modified sequence opt2 from hemagglutinin__InfluenzaA__ACV67225

SEQ ID NO: 94818 - RNA, 1701 nt, Artificial Sequence; identical to SEQ ID NO: 94181
  derived and/or modified sequence opt2 from hemagglutinin__InfluenzaA__ACV67226

SEQ ID NO: 94819 - RNA, 1701 nt, Artificial Sequence
  derived and/or modified sequence opt2 from hemagglutinin__InfluenzaA__ACV67227
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccaacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94820 - RNA, 1701 nt, Artificial Sequence; identical to SEQ ID NO: 94423
  derived and/or modified sequence opt2 from hemagglutinin__InfluenzaA__ACV67228

SEQ ID NO: 94821 - RNA, 1701 nt, Artificial Sequence
  derived and/or modified sequence opt2 from hemagglutinin__InfluenzaA__ACV67229
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaaccccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94822 - RNA, 1701 nt, Artificial Sequence; identical to SEQ ID NO: 94168
  derived and/or modified sequence opt2 from hemagglutinin__InfluenzaA__ACV67230

SEQ ID NO: 94823 - RNA, 1701 nt, Artificial Sequence; identical to SEQ ID NO: 94181
  derived and/or modified sequence opt2 from hemagglutinin__InfluenzaA__ACV67231

SEQ ID NO: 94824 - RNA, 1701 nt, Artificial Sequence; identical to SEQ ID NO: 94181
  derived and/or modified sequence opt2 from hemagglutinin__InfluenzaA__ACV67232

SEQ ID NO: 94825 - RNA, 1701 nt, Artificial Sequence; identical to SEQ ID NO: 94168
  derived and/or modified sequence opt2 from hemagglutinin__InfluenzaA__ACV67233

SEQ ID NO: 94826 - RNA, 1701 nt, Artificial Sequence; identical to SEQ ID NO: 94423
  derived and/or modified sequence opt2 from hemagglutinin__InfluenzaA__ACV67234

SEQ ID NO: 94827 - RNA, 1701 nt, Artificial Sequence
  derived and/or modified sequence opt2 from hemagglutinin__InfluenzaA__ACV67235
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaacgagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94828 - RNA, 1701 nt, Artificial Sequence; identical to SEQ ID NO: 94425
  derived and/or modified sequence opt2 from hemagglutinin__InfluenzaA__ACV67236

SEQ ID NO: 94829 - RNA, 1701 nt, Artificial Sequence; identical to SEQ ID NO: 94168
  derived and/or modified sequence opt2 from hemagglutinin__InfluenzaA__ACV67238

SEQ ID NO: 94830 - RNA, 1701 nt, Artificial Sequence
  derived and/or modified sequence opt2 from hemagglutinin__InfluenzaA__ACV67239
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94831 - RNA, 1701 nt, Artificial Sequence; identical to SEQ ID NO: 94425
  derived and/or modified sequence opt2 from hemagglutinin__InfluenzaA__ACV67240

SEQ ID NO: 94832 - RNA, 1701 nt, Artificial Sequence
  derived and/or modified sequence opt2 from hemagglutinin__InfluenzaA__ACV67241
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaacggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94833 - RNA, 1701 nt, Artificial Sequence; identical to SEQ ID NO: 94423
  derived and/or modified sequence opt2 from hemagglutinin__InfluenzaA__ACV67242

SEQ ID NO: 94834 - RNA, 1701 nt, Artificial Sequence; identical to SEQ ID NO: 94361
  derived and/or modified sequence opt2 from hemagglutinin__InfluenzaA__ACV67244

SEQ ID NO: 94835 - RNA, 1701 nt, Artificial Sequence; identical to SEQ ID NO: 94274
  derived and/or modified sequence opt2 from hemagglutinin__InfluenzaA__ACV67246

SEQ ID NO: 94836 - RNA, 1701 nt, Artificial Sequence; identical to SEQ ID NO: 94805
  derived and/or modified sequence opt2 from hemagglutinin__InfluenzaA__ACV67247

SEQ ID NO: 94837 - RNA, 1701 nt, Artificial Sequence; identical to SEQ ID NO: 94168
  derived and/or modified sequence opt2 from hemagglutinin__InfluenzaA__ACV70073

SEQ ID NO: 94838 - RNA, 1701 nt, Artificial Sequence; identical to SEQ ID NO: 94168
  derived and/or modified sequence opt2 from hemagglutinin__InfluenzaA__ACV70093

SEQ ID NO: 94839 - RNA, 1701 nt, Artificial Sequence; identical to SEQ ID NO: 94168
  derived and/or modified sequence opt2 from hemagglutinin__InfluenzaA__ACV70103

SEQ ID NO: 94840 - RNA, 1701 nt, Artificial Sequence; identical to SEQ ID NO: 94168
  derived and/or modified sequence opt2 from hemagglutinin__InfluenzaA__ACV70113

SEQ ID NO: 94841 - RNA, 1701 nt, Artificial Sequence; identical to SEQ ID NO: 94168
  derived and/or modified sequence opt2 from hemagglutinin__InfluenzaA__ACV70123

SEQ ID NO: 94842 - RNA, 1701 nt, Artificial Sequence; identical to SEQ ID NO: 94168
  derived and/or modified sequence opt2 from hemagglutinin__InfluenzaA__ACV70154

SEQ ID NO: 94843 - RNA, 1701 nt, Artificial Sequence
  derived and/or modified sequence opt2 from hemagglutinin__InfluenzaA__ACV70164
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccucaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94844 - RNA, 1701 nt, Artificial Sequence; identical to SEQ ID NO: 94168
  derived and/or modified sequence opt2 from hemagglutinin__InfluenzaA__ACV70174

SEQ ID NO: 94845 - RNA, 1701 nt, Artificial Sequence; identical to SEQ ID NO: 94168
  derived and/or modified sequence opt2 from hemagglutinin__InfluenzaA__ACV70184

SEQ ID NO: 94846 - RNA, 1701 nt, Artificial Sequence; identical to SEQ ID NO: 94168
  derived and/or modified sequence opt2 from hemagglutinin__InfluenzaA__ACV70194

SEQ ID NO: 94847 - RNA, 1701 nt, Artificial Sequence; identical to SEQ ID NO: 94168
  derived and/or modified sequence opt2 from hemagglutinin__InfluenzaA__ACV70204

SEQ ID NO: 94848 - RNA, 1701 nt, Artificial Sequence; identical to SEQ ID NO: 94168
  derived and/or modified sequence opt2 from hemagglutinin__InfluenzaA__ACV70214

SEQ ID NO: 94849 - RNA, 1701 nt, Artificial Sequence; identical to SEQ ID NO: 94168
  derived and/or modified sequence opt2 from hemagglutinin__InfluenzaA__ACV70224

SEQ ID NO: 94850 - RNA, 1701 nt, Artificial Sequence; identical to SEQ ID NO: 94168
  derived and/or modified sequence opt2 from hemagglutinin__InfluenzaA__ACV70234

SEQ ID NO: 94851 - RNA, 1701 nt, Artificial Sequence; identical to SEQ ID NO: 94168
  derived and/or modified sequence opt2 from hemagglutinin__InfluenzaA__ACV70254

SEQ ID NO: 94852 - RNA, 1701 nt, Artificial Sequence; identical to SEQ ID NO: 94168
  derived and/or modified sequence opt2 from hemagglutinin__InfluenzaA__ACV70264

SEQ ID NO: 94853 - RNA, 1701 nt, Artificial Sequence; identical to SEQ ID NO: 94168
  derived and/or modified sequence opt2 from hemagglutinin__InfluenzaA__ACV70274

SEQ ID NO: 94854 - RNA, 1701 nt, Artificial Sequence; identical to SEQ ID NO: 94168
  derived and/or modified sequence opt2 from hemagglutinin__InfluenzaA__ACV70284

SEQ ID NO: 94855 - RNA, 1701 nt, Artificial Sequence; identical to SEQ ID NO: 94168
  derived and/or modified sequence opt2 from hemagglutinin__InfluenzaA__ACV70294

SEQ ID NO: 94856 - RNA, 1701 nt, Artificial Sequence; identical to SEQ ID NO: 94168
  derived and/or modified sequence opt2 from hemagglutinin__InfluenzaA__ACV70304

SEQ ID NO: 94857 - RNA, 1701 nt, Artificial Sequence; identical to SEQ ID NO: 94843
  derived and/or modified sequence opt2 from hemagglutinin__InfluenzaA__ACV70314

SEQ ID NO: 94858 - RNA, 1701 nt, Artificial Sequence
  derived and/or modified sequence opt2 from hemagglutinin__InfluenzaA__ACV70324
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuucaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94859 - RNA, 1701 nt, Artificial Sequence; identical to SEQ ID NO: 94168
  derived and/or modified sequence opt2 from hemagglutinin__InfluenzaA__ACV70334

SEQ ID NO: 94860 - RNA, 1701 nt, Artificial Sequence; identical to SEQ ID NO: 94168
  derived and/or modified sequence opt2 from hemagglutinin__InfluenzaA__ACV70344

SEQ ID NO: 94861 - RNA, 1701 nt, Artificial Sequence; identical to SEQ ID NO: 94168
  derived and/or modified sequence opt2 from hemagglutinin__InfluenzaA__ACV70354

SEQ ID NO: 94862 - RNA, 1701 nt, Artificial Sequence; identical to SEQ ID NO: 94168
  derived and/or modified sequence opt2 from hemagglutinin__InfluenzaA__ACV70364

SEQ ID NO: 94863 - RNA, 1701 nt, Artificial Sequence; identical to SEQ ID NO: 94168
  derived and/or modified sequence opt2 from hemagglutinin__InfluenzaA__ACV70374

SEQ ID NO: 94864 - RNA, 1701 nt, Artificial Sequence; identical to SEQ ID NO: 94168
  derived and/or modified sequence opt2 from hemagglutinin__InfluenzaA__ACV70384

SEQ ID NO: 94865 - RNA, 1701 nt, Artificial Sequence; identical to SEQ ID NO: 94168
  derived and/or modified sequence opt2 from hemagglutinin__InfluenzaA__ACV70394

SEQ ID NO: 94866 - RNA, 1701 nt, Artificial Sequence; identical to SEQ ID NO: 94168
  derived and/or modified sequence opt2 from hemagglutinin__InfluenzaA__ACV70404

SEQ ID NO: 94867 - RNA, 1701 nt, Artificial Sequence; identical to SEQ ID NO: 94843
  derived and/or modified sequence opt2 from hemagglutinin__InfluenzaA__ACV70414

SEQ ID NO: 94868 - RNA, 1701 nt, Artificial Sequence; identical to SEQ ID NO: 94168
  derived and/or modified sequence opt2 from hemagglutinin__InfluenzaA__ACV70424

SEQ ID NO: 94869 - RNA, 1701 nt, Artificial Sequence; identical to SEQ ID NO: 94168
  derived and/or modified sequence opt2 from hemagglutinin__InfluenzaA__ACV70434

SEQ ID NO: 94870 - RNA, 1701 nt, Artificial Sequence; identical to SEQ ID NO: 94168
  derived and/or modified sequence opt2 from hemagglutinin__InfluenzaA__ACV70444

SEQ ID NO: 94871 - RNA, 1701 nt, Artificial Sequence; identical to SEQ ID NO: 94168
  derived and/or modified sequence opt2 from hemagglutinin__InfluenzaA__ACV70454

SEQ ID NO: 94872 - RNA, 1701 nt, Artificial Sequence; identical to SEQ ID NO: 94168
  derived and/or modified sequence opt2 from hemagglutinin__InfluenzaA__ACV70464

SEQ ID NO: 94873 - RNA, 1701 nt, Artificial Sequence; identical to SEQ ID NO: 94168
  derived and/or modified sequence opt2 from hemagglutinin__InfluenzaA__ACV70474

SEQ ID NO: 94874 - RNA, 1701 nt, Artificial Sequence; identical to SEQ ID NO: 94168
  derived and/or modified sequence opt2 from hemagglutinin__InfluenzaA__ACV70484

SEQ ID NO: 94875 - RNA, 1701 nt, Artificial Sequence; identical to SEQ ID NO: 94168
  derived and/or modified sequence opt2 from hemagglutinin__InfluenzaA__ACV70494

SEQ ID NO: 94876 - RNA, 1701 nt, Artificial Sequence; identical to SEQ ID NO: 94168
  derived and/or modified sequence opt2 from hemagglutinin__InfluenzaA__ACV70504

SEQ ID NO: 94877 - RNA, 1701 nt, Artificial Sequence; identical to SEQ ID NO: 94168
  derived and/or modified sequence opt2 from hemagglutinin__InfluenzaA__ACV70514

SEQ ID NO: 94878 - RNA, 1701 nt, Artificial Sequence; identical to SEQ ID NO: 94168
  derived and/or modified sequence opt2 from hemagglutinin__InfluenzaA__ACV70524

SEQ ID NO: 94879 - RNA, 1701 nt, Artificial Sequence; identical to SEQ ID NO: 94361
  derived and/or modified sequence opt2 from hemagglutinin__InfluenzaA__ACV70534

SEQ ID NO: 94880 - RNA, 1701 nt, Artificial Sequence; identical to SEQ ID NO: 94168
  derived and/or modified sequence opt2 from hemagglutinin__InfluenzaA__ACV70544

SEQ ID NO: 94881 - RNA, 1701 nt, Artificial Sequence; identical to SEQ ID NO: 94168
  derived and/or modified sequence opt2 from hemagglutinin__InfluenzaA__ACV70564

SEQ ID NO: 94882 - RNA, 1701 nt, Artificial Sequence; identical to SEQ ID NO: 94168
  derived and/or modified sequence opt2 from hemagglutinin__InfluenzaA__ACV70584

SEQ ID NO: 94883 - RNA, 1701 nt, Artificial Sequence; identical to SEQ ID NO: 94843
  derived and/or modified sequence opt2 from hemagglutinin__InfluenzaA__ACV70594

SEQ ID NO: 94884 - RNA, 1701 nt, Artificial Sequence; identical to SEQ ID NO: 94168
  derived and/or modified sequence opt2 from hemagglutinin__InfluenzaA__ACV70604

SEQ ID NO: 94885 - RNA, 1701 nt, Artificial Sequence; identical to SEQ ID NO: 94168
  derived and/or modified sequence opt2 from hemagglutinin__InfluenzaA__ACV70614

SEQ ID NO: 94886 - RNA, 1701 nt, Artificial Sequence; identical to SEQ ID NO: 94168
  derived and/or modified sequence opt2 from hemagglutinin__InfluenzaA__ACV70624

SEQ ID NO: 94887 - RNA, 1701 nt, Artificial Sequence; identical to SEQ ID NO: 94168
  derived and/or modified sequence opt2 from hemagglutinin__InfluenzaA__ACV70634

SEQ ID NO: 94888 - RNA, 1701 nt, Artificial Sequence; identical to SEQ ID NO: 94168
  derived and/or modified sequence opt2 from hemagglutinin__InfluenzaA__ACV70644

SEQ ID NO: 94889 - RNA, 1701 nt, Artificial Sequence; identical to SEQ ID NO: 94168
  derived and/or modified sequence opt2 from hemagglutinin__InfluenzaA__ACV70654

SEQ ID NO: 94890 - RNA, 1701 nt, Artificial Sequence; identical to SEQ ID NO: 94168
  derived and/or modified sequence opt2 from hemagglutinin__InfluenzaA__ACV70664

SEQ ID NO: 94891 - RNA, 1701 nt, Artificial Sequence; identical to SEQ ID NO: 94168
  derived and/or modified sequence opt2 from hemagglutinin__InfluenzaA__ACV70674

SEQ ID NO: 94892 - RNA, 1701 nt, Artificial Sequence; identical to SEQ ID NO: 94168
  derived and/or modified sequence opt2 from hemagglutinin__InfluenzaA__ACV70684

SEQ ID NO: 94893 - RNA, 1701 nt, Artificial Sequence; identical to SEQ ID NO: 94168
  derived and/or modified sequence opt2 from hemagglutinin__InfluenzaA__ACV70694

SEQ ID NO: 94894 - RNA, 1701 nt, Artificial Sequence; identical to SEQ ID NO: 94168
  derived and/or modified sequence opt2 from hemagglutinin__InfluenzaA__ACV70704

SEQ ID NO: 94895 - RNA, 1701 nt, Artificial Sequence; identical to SEQ ID NO: 94168
  derived and/or modified sequence opt2 from hemagglutinin__InfluenzaA__ACV70714

SEQ ID NO: 94896 - RNA, 1701 nt, Artificial Sequence; identical to SEQ ID NO: 94168
  derived and/or modified sequence opt2 from hemagglutinin__InfluenzaA__ACV70724

SEQ ID NO: 94897 - RNA, 1701 nt, Artificial Sequence; identical to SEQ ID NO: 94805
  derived and/or modified sequence opt2 from hemagglutinin__InfluenzaA__ACV70734

SEQ ID NO: 94898 - RNA, 1701 nt, Artificial Sequence; identical to SEQ ID NO: 94168
  derived and/or modified sequence opt2 from hemagglutinin__InfluenzaA__ACV70744

SEQ ID NO: 94899 - RNA, 1701 nt, Artificial Sequence; identical to SEQ ID NO: 94168
  derived and/or modified sequence opt2 from hemagglutinin__InfluenzaA__ACV70754

SEQ ID NO: 94900 - RNA, 1701 nt, Artificial Sequence; identical to SEQ ID NO: 94168
  derived and/or modified sequence opt2 from hemagglutinin__InfluenzaA__ACV70764

SEQ ID NO: 94901 - RNA, 1701 nt, Artificial Sequence; identical to SEQ ID NO: 94168
  derived and/or modified sequence opt2 from hemagglutinin__InfluenzaA__ACV70784

SEQ ID NO: 94902 - RNA, 1701 nt, Artificial Sequence
  derived and/or modified sequence opt2 from hemagglutinin__InfluenzaA__ACV70794
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgccaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94903 - RNA, 1701 nt, Artificial Sequence; identical to SEQ ID NO: 94168
  derived and/or modified sequence opt2 from hemagglutinin__InfluenzaA__ACV70804

SEQ ID NO: 94904 - RNA, 1701 nt, Artificial Sequence; identical to SEQ ID NO: 94843
  derived and/or modified sequence opt2 from hemagglutinin__InfluenzaA__ACV70824

SEQ ID NO: 94905 - RNA, 1701 nt, Artificial Sequence; identical to SEQ ID NO: 94168
  derived and/or modified sequence opt2 from hemagglutinin__InfluenzaA__ACV70834

SEQ ID NO: 94906 - RNA, 1701 nt, Artificial Sequence
  derived and/or modified sequence opt2 from hemagglutinin__InfluenzaA__ACV70844
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94907 - RNA, 1701 nt, Artificial Sequence; identical to SEQ ID NO: 94168
  derived and/or modified sequence opt2 from hemagglutinin__InfluenzaA__ACV70854

SEQ ID NO: 94908 - RNA, 1701 nt, Artificial Sequence
  derived and/or modified sequence opt2 from hemagglutinin__InfluenzaA__ACV70864
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaccuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94909 - RNA, 1701 nt, Artificial Sequence; identical to SEQ ID NO: 94168
  derived and/or modified sequence opt2 from hemagglutinin__InfluenzaA__ACV70874

SEQ ID NO: 94910 - RNA, 1701 nt, Artificial Sequence; identical to SEQ ID NO: 94361
  derived and/or modified sequence opt2 from hemagglutinin__InfluenzaA__ACV70884

SEQ ID NO: 94911 - RNA, 1701 nt, Artificial Sequence
  derived and/or modified sequence opt2 from hemagglutinin__InfluenzaA__ACV70904
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94912 - RNA, 1701 nt, Artificial Sequence; identical to SEQ ID NO: 94168
  derived and/or modified sequence opt2 from hemagglutinin__InfluenzaA__ACV70914

SEQ ID NO: 94913 - RNA, 1701 nt, Artificial Sequence; identical to SEQ ID NO: 94168
  derived and/or modified sequence opt2 from hemagglutinin__InfluenzaA__ACV70924

SEQ ID NO: 94914 - RNA, 1701 nt, Artificial Sequence; identical to SEQ ID NO: 94168
  derived and/or modified sequence opt2 from hemagglutinin__InfluenzaA__ACV70934

SEQ ID NO: 94915 - RNA, 1701 nt, Artificial Sequence; identical to SEQ ID NO: 94168
  derived and/or modified sequence opt2 from hemagglutinin__InfluenzaA__ACV70944

SEQ ID NO: 94916 - RNA, 1701 nt, Artificial Sequence
  derived and/or modified sequence opt2 from hemagglutinin__InfluenzaA__ACV70954
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94917 - RNA, 1701 nt, Artificial Sequence; identical to SEQ ID NO: 94168
  derived and/or modified sequence opt2 from hemagglutinin__InfluenzaA__ACV70964

SEQ ID NO: 94918 - RNA, 1701 nt, Artificial Sequence; identical to SEQ ID NO: 94168
  derived and/or modified sequence opt2 from hemagglutinin__InfluenzaA__ACV70974

SEQ ID NO: 94919 - RNA, 1701 nt, Artificial Sequence; identical to SEQ ID NO: 94911
  derived and/or modified sequence opt2 from hemagglutinin__InfluenzaA__ACV70984

SEQ ID NO: 94920 - RNA, 1701 nt, Artificial Sequence; identical to SEQ ID NO: 94916
  derived and/or modified sequence opt2 from hemagglutinin__InfluenzaA__ACV70994

SEQ ID NO: 94921 - RNA, 1701 nt, Artificial Sequence; identical to SEQ ID NO: 94168
  derived and/or modified sequence opt2 from hemagglutinin__InfluenzaA__ACV71004

SEQ ID NO: 94922 - RNA, 1701 nt, Artificial Sequence
  derived and/or modified sequence opt2 from hemagglutinin__InfluenzaA__ACV82230
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcucccaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccaggcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94923 - RNA, 1701 nt, Artificial Sequence
  derived and/or modified sequence opt2 from hemagglutinin__InfluenzaA__ACV82232
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94924 - RNA, 1698 nt, Artificial Sequence
  derived and/or modified sequence opt2 from hemagglutinin__InfluenzaA__ACV82233
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagauccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94925 - RNA, 1701 nt, Artificial Sequence
  derived and/or modified sequence opt2 from hemagglutinin__InfluenzaA__ACV83662
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94926 - RNA, 1701 nt, Artificial Sequence
  derived and/or modified sequence opt2 from hemagglutinin__InfluenzaA__ACV83663
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94927 - RNA, 1701 nt, Artificial Sequence; identical to SEQ ID NO: 94926
  derived and/or modified sequence opt2 from hemagglutinin__InfluenzaA__ACV83664

SEQ ID NO: 94928 - RNA, 1701 nt, Artificial Sequence
  derived and/or modified sequence opt2 from hemagglutinin__InfluenzaA__ACV83665
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaucgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94929 - RNA, 1701 nt, Artificial Sequence
  derived and/or modified sequence opt2 from hemagglutinin__InfluenzaA__ACV83667
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94930 - RNA, 1701 nt, Artificial Sequence; identical to SEQ ID NO: 94181
  derived and/or modified sequence opt2 from hemagglutinin__InfluenzaA__ACV83668

SEQ ID NO: 94931 - RNA, 1701 nt, Artificial Sequence; identical to SEQ ID NO: 94181
  derived and/or modified sequence opt2 from hemagglutinin__InfluenzaA__ACV83670

SEQ ID NO: 94932 - RNA, 1701 nt, Artificial Sequence; identical to SEQ ID NO: 94423
  derived and/or modified sequence opt2 from hemagglutinin__InfluenzaA__ACV83671

SEQ ID NO: 94933 - RNA, 1701 nt, Artificial Sequence; identical to SEQ ID NO: 94743
  derived and/or modified sequence opt2 from hemagglutinin__InfluenzaA__ACV88399

SEQ ID NO: 94934 - RNA, 1701 nt, Artificial Sequence; identical to SEQ ID NO: 94743
  derived and/or modified sequence opt2 from hemagglutinin__InfluenzaA__ACV88409

SEQ ID NO: 94935 - RNA, 1701 nt, Artificial Sequence; identical to SEQ ID NO: 94168
  derived and/or modified sequence opt2 from hemagglutinin__InfluenzaA__ACV88419

SEQ ID NO: 94936 - RNA, 1698 nt, Artificial Sequence; identical to SEQ ID NO: 94790
  derived and/or modified sequence opt2 from hemagglutinin__InfluenzaA__ACV89502

SEQ ID NO: 94937 - RNA, 1701 nt, Artificial Sequence
  derived and/or modified sequence opt2 from hemagglutinin__InfluenzaA__ACV89516
augaaggcccgccuccucauccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgacucccuccuccccgccuccuccugguccuacaucgucgagacccccaacuccaagaacggcaucugcuaccccggcgacuucaucgacuacgaggagcuccgcgagcagcucuccuccgucuccuccuucgagcgcuucgagaucuuccccaaggaguccuccuggcccaagcacuccaccaccaagggcgucaccgccgccugcucccacgccggcaaguccuccuucuaccgcaaccuccucuggcucaccaagaagggcgacuccuaccccaagcucuccaacuccuacgucaacaagaagggcaaggagguccucguccucuggggcguccaccaccccuccuccuccaaggagcagcagacccucuaccagaacgagaacgccuacgucuccgucgucuccuccaacuacaaccgccgcuucauccccgagaucgccgagcgccccgaggucaaggaccaggccggccgcaucaacuacuacuggacccuccucgagcccggcgacaccaucaucuucgaggccaacggcaaccucgucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacgucaaguccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagauccagcucaagaacaacgccaaggagaucggcaacggcugcuucgaguucuaccacaagugcgacaacgagugcauggaguccguccgcaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94938 - RNA, 1698 nt, Artificial Sequence
  derived and/or modified sequence opt2 from hemagglutinin__InfluenzaA__ACV90512
augaacgucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaucgacaagugggacgccaagugccagaccccccagggcgccaucaacuccucccuccccuuccagaacguccaccccgucaccaucggcgaguggcccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaagaugaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucacccucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 94939 - RNA, 1701 nt, Artificial Sequence; identical to SEQ ID NO: 94181
  derived and/or modified sequence opt2 from hemagglutinin__InfluenzaA__ACV91672

SEQ ID NO: 94940 - RNA, 1701 nt, Artificial Sequence; identical to SEQ ID NO: 94181
  derived and/or modified sequence opt2 from hemagglutinin__InfluenzaA__ACV91676

SEQ ID NO: 94941 - RNA, 1701 nt, Artificial Sequence; identical to SEQ ID NO: 94181
  derived and/or modified sequence opt2 from hemagglutinin__InfluenzaA__ACV91680

SEQ ID NO: 94942 - RNA, 1701 nt, Artificial Sequence
  derived and/or modified sequence opt2 from hemagglutinin__InfluenzaA__ACX31591
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccaggcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 94943 - RNA, 1701 nt, Artificial Sequence
  derived and/or modified sequence opt2 from hemagglutinin__InfluenzaA__ACX31933
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94944 - RNA, 1701 nt, Artificial Sequence
  derived and/or modified sequence opt2 from hemagglutinin__InfluenzaA__ACX31934
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucaccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94945 - RNA, 1701 nt, Artificial Sequence; identical to SEQ ID NO: 94181
  derived and/or modified sequence opt2 from hemagglutinin__InfluenzaA__ACX31935

SEQ ID NO: 94946 - RNA, 1701 nt, Artificial Sequence; identical to SEQ ID NO: 94181
  derived and/or modified sequence opt2 from hemagglutinin__InfluenzaA__ACX31936

SEQ ID NO: 94947 - RNA, 1701 nt, Artificial Sequence; identical to SEQ ID NO: 94272
  derived and/or modified sequence opt2 from hemagglutinin__InfluenzaA__ACX31939

SEQ ID NO: 94948 - RNA, 1701 nt, Artificial Sequence; identical to SEQ ID NO: 94272
  derived and/or modified sequence opt2 from hemagglutinin__InfluenzaA__ACX31940

SEQ ID NO: 94949 - RNA, 1701 nt, Artificial Sequence; identical to SEQ ID NO: 94181
  derived and/or modified sequence opt2 from hemagglutinin__InfluenzaA__ACX31943

SEQ ID NO: 94950 - RNA, 1701 nt, Artificial Sequence; identical to SEQ ID NO: 94181
  derived and/or modified sequence opt2 from hemagglutinin__InfluenzaA__ACX31946

SEQ ID NO: 94951 - RNA, 1701 nt, Artificial Sequence; identical to SEQ ID NO: 94181
  derived and/or modified sequence opt2 from hemagglutinin__InfluenzaA__ACX31947

SEQ ID NO: 94952 - RNA, 1701 nt, Artificial Sequence; identical to SEQ ID NO: 94181
  derived and/or modified sequence opt2 from hemagglutinin__InfluenzaA__ACX31948

SEQ ID NO: 94953 - RNA, 1701 nt, Artificial Sequence
  derived and/or modified sequence opt2 from hemagglutinin__InfluenzaA__ACX31949
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacuacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgaggagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94954 - RNA, 1701 nt, Artificial Sequence; identical to SEQ ID NO: 94181
  derived and/or modified sequence opt2 from hemagglutinin__InfluenzaA__ACX31950

SEQ ID NO: 94955 - RNA, 1701 nt, Artificial Sequence; identical to SEQ ID NO: 94181
  derived and/or modified sequence opt2 from hemagglutinin__InfluenzaA__ACX31951

SEQ ID NO: 94956 - RNA, 1701 nt, Artificial Sequence; identical to SEQ ID NO: 94181
  derived and/or modified sequence opt2 from hemagglutinin__InfluenzaA__ACX31954

SEQ ID NO: 94957 - RNA, 1701 nt, Artificial Sequence; identical to SEQ ID NO: 94181
  derived and/or modified sequence opt2 from hemagglutinin__InfluenzaA__ACX31955

SEQ ID NO: 94958 - RNA, 1701 nt, Artificial Sequence; identical to SEQ ID NO: 94168
  derived and/or modified sequence opt2 from hemagglutinin__InfluenzaA__ACX31956

SEQ ID NO: 94959 - RNA, 1701 nt, Artificial Sequence; identical to SEQ ID NO: 94181
  derived and/or modified sequence opt2 from hemagglutinin__InfluenzaA__ACX31957

SEQ ID NO: 94960 - RNA, 1701 nt, Artificial Sequence; identical to SEQ ID NO: 94168
  derived and/or modified sequence opt2 from hemagglutinin__InfluenzaA__ACX31958

SEQ ID NO: 94961 - RNA, 1701 nt, Artificial Sequence; identical to SEQ ID NO: 94423
  derived and/or modified sequence opt2 from hemagglutinin__InfluenzaA__ACX31960

SEQ ID NO: 94962 - RNA, 1701 nt, Artificial Sequence
  derived and/or modified sequence opt2 from hemagglutinin__InfluenzaA__ACX31961
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuucauggacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94963 - RNA, 1701 nt, Artificial Sequence; identical to SEQ ID NO: 94181
  derived and/or modified sequence opt2 from hemagglutinin__InfluenzaA__ACX31962

SEQ ID NO: 94964 - RNA, 1701 nt, Artificial Sequence; identical to SEQ ID NO: 94181
  derived and/or modified sequence opt2 from hemagglutinin__InfluenzaA__ACX31964

SEQ ID NO: 94965 - RNA, 1701 nt, Artificial Sequence; identical to SEQ ID NO: 94168
  derived and/or modified sequence opt2 from hemagglutinin__InfluenzaA__ACX35237

SEQ ID NO: 94966 - RNA, 1701 nt, Artificial Sequence; identical to SEQ ID NO: 94181
  derived and/or modified sequence opt2 from hemagglutinin__InfluenzaA__ACX35247

SEQ ID NO: 94967 - RNA, 1701 nt, Artificial Sequence; identical to SEQ ID NO: 94181
  derived and/or modified sequence opt2 from hemagglutinin__InfluenzaA__ACX35257

SEQ ID NO: 94968 - RNA, 1701 nt, Artificial Sequence; identical to SEQ ID NO: 94181
  derived and/or modified sequence opt2 from hemagglutinin__InfluenzaA__ACX35267

SEQ ID NO: 94969 - RNA, 1701 nt, Artificial Sequence; identical to SEQ ID NO: 94181
  derived and/or modified sequence opt2 from hemagglutinin__InfluenzaA__ACX35277

SEQ ID NO: 94970 - RNA, 1701 nt, Artificial Sequence; identical to SEQ ID NO: 94181
  derived and/or modified sequence opt2 from hemagglutinin__InfluenzaA__ACX35287

SEQ ID NO: 94971 - RNA, 1701 nt, Artificial Sequence; identical to SEQ ID NO: 94181
  derived and/or modified sequence opt2 from hemagglutinin__InfluenzaA__ACX35297

SEQ ID NO: 94972 - RNA, 1701 nt, Artificial Sequence
  derived and/or modified sequence opt2 from hemagglutinin__InfluenzaA__ACX35307
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucggccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94973 - RNA, 1701 nt, Artificial Sequence; identical to SEQ ID NO: 94423
  derived and/or modified sequence opt2 from hemagglutinin__InfluenzaA__ACX35317

SEQ ID NO: 94974 - RNA, 1701 nt, Artificial Sequence
  derived and/or modified sequence opt2 from hemagglutinin__InfluenzaA__ACX35327
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94975 - RNA, 1701 nt, Artificial Sequence
  derived and/or modified sequence opt2 from hemagglutinin__InfluenzaA__ACX36501
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94976 - RNA, 1701 nt, Artificial Sequence
  derived and/or modified sequence opt2 from hemagglutinin__InfluenzaA__ACX36502
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94977 - RNA, 1701 nt, Artificial Sequence
  derived and/or modified sequence opt2 from hemagglutinin__InfluenzaA__ACX36503
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacaccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94978 - RNA, 1701 nt, Artificial Sequence
  derived and/or modified sequence opt2 from hemagglutinin__InfluenzaA__ACX47367
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94979 - RNA, 1701 nt, Artificial Sequence
  derived and/or modified sequence opt2 from hemagglutinin__InfluenzaA__ACX47368
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94980 - RNA, 1701 nt, Artificial Sequence; identical to SEQ ID NO: 94979
  derived and/or modified sequence opt2 from hemagglutinin__InfluenzaA__ACX47369

SEQ ID NO: 94981 - RNA, 1701 nt, Artificial Sequence
  derived and/or modified sequence opt2 from hemagglutinin__InfluenzaA__ACX47370
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccgccagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94982 - RNA, 1701 nt, Artificial Sequence; identical to SEQ ID NO: 94979
  derived and/or modified sequence opt2 from hemagglutinin__InfluenzaA__ACX47371

SEQ ID NO: 94983 - RNA, 1701 nt, Artificial Sequence; identical to SEQ ID NO: 94979
  derived and/or modified sequence opt2 from hemagglutinin__InfluenzaA__ACX47372

SEQ ID NO: 94984 - RNA, 1701 nt, Artificial Sequence; identical to SEQ ID NO: 94979
  derived and/or modified sequence opt2 from hemagglutinin__InfluenzaA__ACX47373

SEQ ID NO: 94985 - RNA, 1701 nt, Artificial Sequence; identical to SEQ ID NO: 94979
  derived and/or modified sequence opt2 from hemagglutinin__InfluenzaA__ACX47374

SEQ ID NO: 94986 - RNA, 1701 nt, Artificial Sequence
  derived and/or modified sequence opt2 from hemagglutinin__InfluenzaA__ACX47375
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94987 - RNA, 1701 nt, Artificial Sequence; identical to SEQ ID NO: 94979
  derived and/or modified sequence opt2 from hemagglutinin__InfluenzaA__ACX47376

SEQ ID NO: 94988 - RNA, 1701 nt, Artificial Sequence; identical to SEQ ID NO: 94979
  derived and/or modified sequence opt2 from hemagglutinin__InfluenzaA__ACX47377

SEQ ID NO: 94989 - RNA, 1701 nt, Artificial Sequence
  derived and/or modified sequence opt2 from hemagglutinin__InfluenzaA__ACX47380
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgucauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94990 - RNA, 1701 nt, Artificial Sequence; identical to SEQ ID NO: 94989
  derived and/or modified sequence opt2 from hemagglutinin__InfluenzaA__ACX47381

SEQ ID NO: 94991 - RNA, 1701 nt, Artificial Sequence; identical to SEQ ID NO: 94989
  derived and/or modified sequence opt2 from hemagglutinin__InfluenzaA__ACX47382

SEQ ID NO: 94992 - RNA, 1701 nt, Artificial Sequence
  derived and/or modified sequence opt2 from hemagglutinin__InfluenzaA__ACX47383
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94993 - RNA, 1701 nt, Artificial Sequence
  derived and/or modified sequence opt2 from hemagglutinin__InfluenzaA__ACX47384
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 94994 - RNA, 1701 nt, Artificial Sequence; identical to SEQ ID NO: 94993
  derived and/or modified sequence opt2 from hemagglutinin__InfluenzaA__ACX47385

SEQ ID NO: 94995 - RNA, 1701 nt, Artificial Sequence; identical to SEQ ID NO: 94993
  derived and/or modified sequence opt2 from hemagglutinin__InfluenzaA__ACX47387

SEQ ID NO: 94996 - RNA, 1701 nt, Artificial Sequence; identical to SEQ ID NO: 94181
  derived and/or modified sequence opt2 from hemagglutinin__InfluenzaA__ACX55834

SEQ ID NO: 94997 - RNA, 1701 nt, Artificial Sequence; identical to SEQ ID NO: 94979
  derived and/or modified sequence opt2 from hemagglutinin__InfluenzaA__ACX61574

SEQ ID NO: 94998 - RNA, 1701 nt, Artificial Sequence; identical to SEQ ID NO: 94181
  derived and/or modified sequence opt2 from hemagglutinin__InfluenzaA__ACX61575

SEQ ID NO: 94999 - RNA, 1701 nt, Artificial Sequence
  derived and/or modified sequence opt2 from hemagglutinin__InfluenzaA__ACX83577
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95000 - RNA, 1701 nt, Artificial Sequence
  derived and/or modified sequence opt2 from hemagglutinin__InfluenzaA__ACX94091
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaucuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugcuccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95001 - RNA, 1701 nt, Artificial Sequence
  derived and/or modified sequence opt2 from hemagglutinin__InfluenzaA__ACY26192
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccaggacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95002 - RNA, 1701 nt, Artificial Sequence; identical to SEQ ID NO: 94750
  derived and/or modified sequence opt2 from hemagglutinin__InfluenzaA__ACY26202

SEQ ID NO: 95003 - RNA, 1701 nt, Artificial Sequence; identical to SEQ ID NO: 94181
  derived and/or modified sequence opt2 from hemagglutinin__InfluenzaA__ACY46103

SEQ ID NO: 95004 - RNA, 1701 nt, Artificial Sequence; identical to SEQ ID NO: 94181
  derived and/or modified sequence opt2 from hemagglutinin__InfluenzaA__ACY46113

SEQ ID NO: 95005 - RNA, 1701 nt, Artificial Sequence
  derived and/or modified sequence opt2 from hemagglutinin__InfluenzaA__ACY46123
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaaggucggcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95006 - RNA, 1701 nt, Artificial Sequence; identical to SEQ ID NO: 94181
  derived and/or modified sequence opt2 from hemagglutinin__InfluenzaA__ACY46133

SEQ ID NO: 95007 - RNA, 1701 nt, Artificial Sequence; identical to SEQ ID NO: 94181
  derived and/or modified sequence opt2 from hemagglutinin__InfluenzaA__ACY46163

SEQ ID NO: 95008 - RNA, 1701 nt, Artificial Sequence
  derived and/or modified sequence opt2 from hemagglutinin__InfluenzaA__ACY46173
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95009 - RNA, 1701 nt, Artificial Sequence; identical to SEQ ID NO: 94181
  derived and/or modified sequence opt2 from hemagglutinin__InfluenzaA__ACY46213

SEQ ID NO: 95010 - RNA, 1701 nt, Artificial Sequence; identical to SEQ ID NO: 94181
  derived and/or modified sequence opt2 from hemagglutinin__InfluenzaA__ACY46223

SEQ ID NO: 95011 - RNA, 1701 nt, Artificial Sequence; identical to SEQ ID NO: 94181
  derived and/or modified sequence opt2 from hemagglutinin__InfluenzaA__ACY46233

SEQ ID NO: 95012 - RNA, 1701 nt, Artificial Sequence; identical to SEQ ID NO: 94181
  derived and/or modified sequence opt2 from hemagglutinin__InfluenzaA__ACY46243

SEQ ID NO: 95013 - RNA, 1701 nt, Artificial Sequence; identical to SEQ ID NO: 94181
  derived and/or modified sequence opt2 from hemagglutinin__InfluenzaA__ACY46253

SEQ ID NO: 95014 - RNA, 1701 nt, Artificial Sequence; identical to SEQ ID NO: 94181
  derived and/or modified sequence opt2 from hemagglutinin__InfluenzaA__ACY46263

SEQ ID NO: 95015 - RNA, 1701 nt, Artificial Sequence; identical to SEQ ID NO: 94181
  derived and/or modified sequence opt2 from hemagglutinin__InfluenzaA__ACY46273

SEQ ID NO: 95016 - RNA, 1701 nt, Artificial Sequence; identical to SEQ ID NO: 94181
  derived and/or modified sequence opt2 from hemagglutinin__InfluenzaA__ACY46283

SEQ ID NO: 95017 - RNA, 1701 nt, Artificial Sequence
  derived and/or modified sequence opt2 from hemagglutinin__InfluenzaA__ACY46293
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccgccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95018 - RNA, 1701 nt, Artificial Sequence; identical to SEQ ID NO: 94181
  derived and/or modified sequence opt2 from hemagglutinin__InfluenzaA__ACY46303

SEQ ID NO: 95019 - RNA, 1701 nt, Artificial Sequence; identical to SEQ ID NO: 94181
  derived and/or modified sequence opt2 from hemagglutinin__InfluenzaA__ACY46313

SEQ ID NO: 95020 - RNA, 1701 nt, Artificial Sequence; identical to SEQ ID NO: 94181
  derived and/or modified sequence opt2 from hemagglutinin__InfluenzaA__ACY46323

SEQ ID NO: 95021 - RNA, 1701 nt, Artificial Sequence; identical to SEQ ID NO: 94181
  derived and/or modified sequence opt2 from hemagglutinin__InfluenzaA__ACY46343

SEQ ID NO: 95022 - RNA, 1701 nt, Artificial Sequence; identical to SEQ ID NO: 94181
  derived and/or modified sequence opt2 from hemagglutinin__InfluenzaA__ACY46353

SEQ ID NO: 95023 - RNA, 1701 nt, Artificial Sequence
  derived and/or modified sequence opt2 from hemagglutinin__InfluenzaA__ACY46373
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95024 - RNA, 1701 nt, Artificial Sequence
  derived and/or modified sequence opt2 from hemagglutinin__InfluenzaA__ACY46383
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95025 - RNA, 1701 nt, Artificial Sequence; identical to SEQ ID NO: 94181
  derived and/or modified sequence opt2 from hemagglutinin__InfluenzaA__ACY46393

SEQ ID NO: 95026 - RNA, 1701 nt, Artificial Sequence; identical to SEQ ID NO: 94181
  derived and/or modified sequence opt2 from hemagglutinin__InfluenzaA__ACY46403

SEQ ID NO: 95027 - RNA, 1701 nt, Artificial Sequence; identical to SEQ ID NO: 94181
  derived and/or modified sequence opt2 from hemagglutinin__InfluenzaA__ACY46413

SEQ ID NO: 95028 - RNA, 1701 nt, Artificial Sequence; identical to SEQ ID NO: 94181
  derived and/or modified sequence opt2 from hemagglutinin__InfluenzaA__ACY46433

SEQ ID NO: 95029 - RNA, 1701 nt, Artificial Sequence; identical to SEQ ID NO: 94181
  derived and/or modified sequence opt2 from hemagglutinin__InfluenzaA__ACY46443

SEQ ID NO: 95030 - RNA, 1701 nt, Artificial Sequence; identical to SEQ ID NO: 94181
  derived and/or modified sequence opt2 from hemagglutinin__InfluenzaA__ACY46453

SEQ ID NO: 95031 - RNA, 1701 nt, Artificial Sequence
  derived and/or modified sequence opt2 from hemagglutinin__InfluenzaA__ACY46463
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95032 - RNA, 1701 nt, Artificial Sequence; identical to SEQ ID NO: 94181
  derived and/or modified sequence opt2 from hemagglutinin__InfluenzaA__ACY46473

SEQ ID NO: 95033 - RNA, 1701 nt, Artificial Sequence; identical to SEQ ID NO: 94168
  derived and/or modified sequence opt2 from hemagglutinin__InfluenzaA__ACY46493

SEQ ID NO: 95034 - RNA, 1701 nt, Artificial Sequence
  derived and/or modified sequence opt2 from hemagglutinin__InfluenzaA__ACY46513
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgacaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95035 - RNA, 1701 nt, Artificial Sequence; identical to SEQ ID NO: 94181
  derived and/or modified sequence opt2 from hemagglutinin__InfluenzaA__ACY46523

SEQ ID NO: 95036 - RNA, 1701 nt, Artificial Sequence; identical to SEQ ID NO: 94181
  derived and/or modified sequence opt2 from hemagglutinin__InfluenzaA__ACY46533

SEQ ID NO: 95037 - RNA, 1701 nt, Artificial Sequence; identical to SEQ ID NO: 94181
  derived and/or modified sequence opt2 from hemagglutinin__InfluenzaA__ACY46562

SEQ ID NO: 95038 - RNA, 1701 nt, Artificial Sequence; identical to SEQ ID NO: 94181
  derived and/or modified sequence opt2 from hemagglutinin__InfluenzaA__ACY46572

SEQ ID NO: 95039 - RNA, 1701 nt, Artificial Sequence; identical to SEQ ID NO: 94181
  derived and/or modified sequence opt2 from hemagglutinin__InfluenzaA__ACY46582

SEQ ID NO: 95040 - RNA, 1701 nt, Artificial Sequence; identical to SEQ ID NO: 94181
  derived and/or modified sequence opt2 from hemagglutinin__InfluenzaA__ACY46592

SEQ ID NO: 95041 - RNA, 1701 nt, Artificial Sequence; identical to SEQ ID NO: 94181
  derived and/or modified sequence opt2 from hemagglutinin__InfluenzaA__ACY46622

SEQ ID NO: 95042 - RNA, 1701 nt, Artificial Sequence
  derived and/or modified sequence opt2 from hemagglutinin__InfluenzaA__ACY46672
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95043 - RNA, 1701 nt, Artificial Sequence; identical to SEQ ID NO: 94181
  derived and/or modified sequence opt2 from hemagglutinin__InfluenzaA__ACY46682

SEQ ID NO: 95044 - RNA, 1701 nt, Artificial Sequence; identical to SEQ ID NO: 94181
  derived and/or modified sequence opt2 from hemagglutinin__InfluenzaA__ACY46692

SEQ ID NO: 95045 - RNA, 1701 nt, Artificial Sequence; identical to SEQ ID NO: 94181
  derived and/or modified sequence opt2 from hemagglutinin__InfluenzaA__ACY46712

SEQ ID NO: 95046 - RNA, 1701 nt, Artificial Sequence
  derived and/or modified sequence opt2 from hemagglutinin__InfluenzaA__ACY46722
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccggccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95047 - RNA, 1701 nt, Artificial Sequence
  derived and/or modified sequence opt2 from hemagglutinin__InfluenzaA__ACY46742
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95048 - RNA, 1701 nt, Artificial Sequence; identical to SEQ ID NO: 94181
  derived and/or modified sequence opt2 from hemagglutinin__InfluenzaA__ACY46762

SEQ ID NO: 95049 - RNA, 1701 nt, Artificial Sequence; identical to SEQ ID NO: 94181
  derived and/or modified sequence opt2 from hemagglutinin__InfluenzaA__ACY46772

SEQ ID NO: 95050 - RNA, 1701 nt, Artificial Sequence; identical to SEQ ID NO: 94181
  derived and/or modified sequence opt2 from hemagglutinin__InfluenzaA__ACY46903

SEQ ID NO: 95051 - RNA, 1701 nt, Artificial Sequence; identical to SEQ ID NO: 94207
  derived and/or modified sequence opt2 from hemagglutinin__InfluenzaA__ACY77534

SEQ ID NO: 95052 - RNA, 1698 nt, Artificial Sequence
  derived and/or modified sequence opt2 from hemagglutinin__InfluenzaA__ACY77544
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95053 - RNA, 1698 nt, Artificial Sequence
  derived and/or modified sequence opt2 from hemagglutinin__InfluenzaA__ACY77554
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccaccuccagugccgcaucugcaucuga

SEQ ID NO: 95054 - RNA, 1695 nt, Artificial Sequence
  derived and/or modified sequence opt2 from hemagglutinin__InfluenzaA__ACY77573
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccaguccgccaucgacgagaucaccaacaaggucaacuccgucaucgagaagaugaacacccagcucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaacgagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 95055 - RNA, 1701 nt, Artificial Sequence
  derived and/or modified sequence opt2 from hemagglutinin__InfluenzaA__ACY77593
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95056 - RNA, 1698 nt, Artificial Sequence
  derived and/or modified sequence opt2 from hemagglutinin__InfluenzaA__ACY77603
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95057 - RNA, 1695 nt, Artificial Sequence
  derived and/or modified sequence opt2 from hemagglutinin__InfluenzaA__ACY77613
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 95058 - RNA, 1701 nt, Artificial Sequence; identical to SEQ ID NO: 94181
  derived and/or modified sequence opt2 from hemagglutinin__InfluenzaA__ACY77623

SEQ ID NO: 95059 - RNA, 1707 nt, Artificial Sequence
  derived and/or modified sequence opt2 from hemagglutinin__InfluenzaA__ACY77653
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccggcucccuccagugccgcaucugcaucuga

SEQ ID NO: 95060 - RNA, 1698 nt, Artificial Sequence
  derived and/or modified sequence opt2 from hemagglutinin__InfluenzaA__ACY77663
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccucugccgcaucugcaucuga

SEQ ID NO: 95061 - RNA, 1698 nt, Artificial Sequence
  derived and/or modified sequence opt2 from hemagglutinin__InfluenzaA__ACY77683
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95062 - RNA, 1698 nt, Artificial Sequence
  derived and/or modified sequence opt2 from hemagglutinin__InfluenzaA__ACY77693
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucaccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95063 - RNA, 1698 nt, Artificial Sequence
  derived and/or modified sequence opt2 from hemagglutinin__InfluenzaA__ACY77703
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95064 - RNA, 1698 nt, Artificial Sequence
  derived and/or modified sequence opt2 from hemagglutinin__InfluenzaA__ACY77713
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccaccuccagugccgcaucugcaucuga

SEQ ID NO: 95065 - RNA, 1701 nt, Artificial Sequence; identical to SEQ ID NO: 94494
  derived and/or modified sequence opt2 from hemagglutinin__InfluenzaA__ACY77723

SEQ ID NO: 95066 - RNA, 1695 nt, Artificial Sequence
  derived and/or modified sequence opt2 from hemagglutinin__InfluenzaA__ACY77733
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaccggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccuccagugccgcaucugcaucuga

SEQ ID NO: 95067 - RNA, 1698 nt, Artificial Sequence
  derived and/or modified sequence opt2 from hemagglutinin__InfluenzaA__ACY77743
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95068 - RNA, 1701 nt, Artificial Sequence; identical to SEQ ID NO: 94181
  derived and/or modified sequence opt2 from hemagglutinin__InfluenzaA__ACY77753

SEQ ID NO: 95069 - RNA, 1695 nt, Artificial Sequence
  derived and/or modified sequence opt2 from hemagglutinin__InfluenzaA__ACY77783
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucggcgacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagucccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 95070 - RNA, 1698 nt, Artificial Sequence
  derived and/or modified sequence opt2 from hemagglutinin__InfluenzaA__ACY77813
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccaccuccagugccgcaucugcaucuga

SEQ ID NO: 95071 - RNA, 1698 nt, Artificial Sequence
  derived and/or modified sequence opt2 from hemagglutinin__InfluenzaA__ACY77823
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccggccagugcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95072 - RNA, 1698 nt, Artificial Sequence
  derived and/or modified sequence opt2 from hemagglutinin__InfluenzaA__ACY77833
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccuggucccuccagugccgcaucugcaucuga

SEQ ID NO: 95073 - RNA, 1698 nt, Artificial Sequence
  derived and/or modified sequence opt2 from hemagglutinin__InfluenzaA__ACY77843
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccaccuccagugccgcaucugcaucuga

SEQ ID NO: 95074 - RNA, 1701 nt, Artificial Sequence
  derived and/or modified sequence opt2 from hemagglutinin__InfluenzaA__ACY77863
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggcaugucccuccagugccgcaucugcaucuga

SEQ ID NO: 95075 - RNA, 1701 nt, Artificial Sequence; identical to SEQ ID NO: 94168
  derived and/or modified sequence opt2 from hemagglutinin__InfluenzaA__ACY77874

SEQ ID NO: 95076 - RNA, 1701 nt, Artificial Sequence; identical to SEQ ID NO: 94168
  derived and/or modified sequence opt2 from hemagglutinin__InfluenzaA__ACY77884

SEQ ID NO: 95077 - RNA, 1701 nt, Artificial Sequence
  derived and/or modified sequence opt2 from hemagglutinin__InfluenzaA__ACY77904
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaagcacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95078 - RNA, 1701 nt, Artificial Sequence; identical to SEQ ID NO: 94361
  derived and/or modified sequence opt2 from hemagglutinin__InfluenzaA__ACY77914

SEQ ID NO: 95079 - RNA, 1701 nt, Artificial Sequence
  derived and/or modified sequence opt2 from hemagglutinin__InfluenzaA__ACY77924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95080 - RNA, 1701 nt, Artificial Sequence; identical to SEQ ID NO: 94929
  derived and/or modified sequence opt2 from hemagglutinin__InfluenzaA__ACY77934

SEQ ID NO: 95081 - RNA, 1701 nt, Artificial Sequence
  derived and/or modified sequence opt2 from hemagglutinin__InfluenzaA__ACY77944
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95082 - RNA, 1701 nt, Artificial Sequence; identical to SEQ ID NO: 94168
  derived and/or modified sequence opt2 from hemagglutinin__InfluenzaA__ACY77954

SEQ ID NO: 95083 - RNA, 1701 nt, Artificial Sequence; identical to SEQ ID NO: 94168
  derived and/or modified sequence opt2 from hemagglutinin__InfluenzaA__ACY77964

SEQ ID NO: 95084 - RNA, 1701 nt, Artificial Sequence; identical to SEQ ID NO: 94168
  derived and/or modified sequence opt2 from hemagglutinin__InfluenzaA__ACY77974

SEQ ID NO: 95085 - RNA, 1701 nt, Artificial Sequence; identical to SEQ ID NO: 94168
  derived and/or modified sequence opt2 from hemagglutinin__InfluenzaA__ACY77984

SEQ ID NO: 95086 - RNA, 1701 nt, Artificial Sequence; identical to SEQ ID NO: 94168
  derived and/or modified sequence opt2 from hemagglutinin__InfluenzaA__ACY77994

SEQ ID NO: 95087 - RNA, 1701 nt, Artificial Sequence
  derived and/or modified sequence opt2 from hemagglutinin__InfluenzaA__ACY79633
augaaggagauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgcccgcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95088 - RNA, 1701 nt, Artificial Sequence; identical to SEQ ID NO: 94979
  derived and/or modified sequence opt2 from hemagglutinin__InfluenzaA__ACZ01953

SEQ ID NO: 95089 - RNA, 1701 nt, Artificial Sequence
  derived and/or modified sequence opt2 from hemagglutinin__InfluenzaA__ACZ05050
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95090 - RNA, 1701 nt, Artificial Sequence
  derived and/or modified sequence opt2 from hemagglutinin__InfluenzaA__ACZ05061
auggaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccucaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95091 - RNA, 1701 nt, Artificial Sequence; identical to SEQ ID NO: 94168
  derived and/or modified sequence opt2 from hemagglutinin__InfluenzaA__ACZ05071

SEQ ID NO: 95092 - RNA, 1701 nt, Artificial Sequence; identical to SEQ ID NO: 94168
  derived and/or modified sequence opt2 from hemagglutinin__InfluenzaA__ACZ05081

SEQ ID NO: 95093 - RNA, 1701 nt, Artificial Sequence; identical to SEQ ID NO: 94168
  derived and/or modified sequence opt2 from hemagglutinin__InfluenzaA__ACZ05091

SEQ ID NO: 95094 - RNA, 1701 nt, Artificial Sequence; identical to SEQ ID NO: 94168
  derived and/or modified sequence opt2 from hemagglutinin__InfluenzaA__ACZ05101

SEQ ID NO: 95095 - RNA, 1701 nt, Artificial Sequence; identical to SEQ ID NO: 94168
  derived and/or modified sequence opt2 from hemagglutinin__InfluenzaA__ACZ05111

SEQ ID NO: 95096 - RNA, 1701 nt, Artificial Sequence
  derived and/or modified sequence opt2 from hemagglutinin__InfluenzaA__ACZ05121
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaacaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcaugggcuccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95097 - RNA, 1701 nt, Artificial Sequence; identical to SEQ ID NO: 94168
  derived and/or modified sequence opt2 from hemagglutinin__InfluenzaA__ACZ05131

SEQ ID NO: 95098 - RNA, 1701 nt, Artificial Sequence; identical to SEQ ID NO: 94168
  derived and/or modified sequence opt2 from hemagglutinin__InfluenzaA__ACZ05141

SEQ ID NO: 95099 - RNA, 1701 nt, Artificial Sequence; identical to SEQ ID NO: 94168
  derived and/or modified sequence opt2 from hemagglutinin__InfluenzaA__ACZ05151

SEQ ID NO: 95100 - RNA, 1701 nt, Artificial Sequence
  derived and/or modified sequence opt2 from hemagglutinin__InfluenzaA__ACZ05172
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95101 - RNA, 1698 nt, Artificial Sequence; identical to SEQ ID NO: 94643
  derived and/or modified sequence opt2 from hemagglutinin__InfluenzaA__ACZ05194

SEQ ID NO: 95102 - RNA, 1701 nt, Artificial Sequence; identical to SEQ ID NO: 95100
  derived and/or modified sequence opt2 from hemagglutinin__InfluenzaA__ACZ05205

SEQ ID NO: 95103 - RNA, 1701 nt, Artificial Sequence
  derived and/or modified sequence opt2 from hemagglutinin__InfluenzaA__ACZ05216
augaagaccaucaucgcccucuccuacauccucugccucgucuucgcccagaagauccccggcaacgacaacaacaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95104 - RNA, 1701 nt, Artificial Sequence; identical to SEQ ID NO: 95100
  derived and/or modified sequence opt2 from hemagglutinin__InfluenzaA__ACZ05227

SEQ ID NO: 95105 - RNA, 1701 nt, Artificial Sequence
  derived and/or modified sequence opt2 from hemagglutinin__InfluenzaA__ACZ05238
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95106 - RNA, 1701 nt, Artificial Sequence; identical to SEQ ID NO: 95100
  derived and/or modified sequence opt2 from hemagglutinin__InfluenzaA__ACZ05249

SEQ ID NO: 95107 - RNA, 1701 nt, Artificial Sequence; identical to SEQ ID NO: 95100
  derived and/or modified sequence opt2 from hemagglutinin__InfluenzaA__ACZ05260

SEQ ID NO: 95108 - RNA, 1701 nt, Artificial Sequence
  derived and/or modified sequence opt2 from hemagglutinin__InfluenzaA__ACZ05271
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95109 - RNA, 1701 nt, Artificial Sequence
  derived and/or modified sequence opt2 from hemagglutinin__InfluenzaA__ACZ05282
augaagaccaccaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95110 - RNA, 1701 nt, Artificial Sequence; identical to SEQ ID NO: 95100
  derived and/or modified sequence opt2 from hemagglutinin__InfluenzaA__ACZ05304

SEQ ID NO: 95111 - RNA, 1701 nt, Artificial Sequence; identical to SEQ ID NO: 94923
  derived and/or modified sequence opt2 from hemagglutinin__InfluenzaA__ACZ05315

SEQ ID NO: 95112 - RNA, 1701 nt, Artificial Sequence; identical to SEQ ID NO: 95100
  derived and/or modified sequence opt2 from hemagglutinin__InfluenzaA__ACZ05326

SEQ ID NO: 95113 - RNA, 1701 nt, Artificial Sequence
  derived and/or modified sequence opt2 from hemagglutinin__InfluenzaA__ACZ05337
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagcgcuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucuccuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuucaaggacuggauccucuggaucuccuucgccaucuccugcuuccuccucugcgucgcccuccucggcuucaucaugugggccugccagaagggcaacauccgcugcaacaucugcaucuga

SEQ ID NO: 95114 - RNA, 1701 nt, Artificial Sequence; identical to SEQ ID NO: 95100
  derived and/or modified sequence opt2 from hemagglutinin__InfluenzaA__ACZ05348

SEQ ID NO: 95115 - RNA, 1701 nt, Artificial Sequence; identical to SEQ ID NO: 95105
  derived and/or modified sequence opt2 from hemagglutinin__InfluenzaA__ACZ05359

SEQ ID NO: 95116 - RNA, 1701 nt, Artificial Sequence; identical to SEQ ID NO: 95100
  derived and/or modified sequence opt2 from hemagglutinin__InfluenzaA__ACZ05370

SEQ ID NO: 95117 - RNA, 1701 nt, Artificial Sequence
  derived and/or modified sequence opt2 from hemagglutinin__InfluenzaA__ACZ05392
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcgccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95118 - RNA, 1701 nt, Artificial Sequence; identical to SEQ ID NO: 95100
  derived and/or modified sequence opt2 from hemagglutinin__InfluenzaA__ACZ05403

SEQ ID NO: 95119 - RNA, 1701 nt, Artificial Sequence
  derived and/or modified sequence opt2 from hemagglutinin__InfluenzaA__ACZ05436
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaaguccugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95120 - RNA, 1701 nt, Artificial Sequence; identical to SEQ ID NO: 95100
  derived and/or modified sequence opt2 from hemagglutinin__InfluenzaA__ACZ05458

SEQ ID NO: 95121 - RNA, 1701 nt, Artificial Sequence; identical to SEQ ID NO: 95100
  derived and/or modified sequence opt2 from hemagglutinin__InfluenzaA__ACZ05469

SEQ ID NO: 95122 - RNA, 1701 nt, Artificial Sequence; identical to SEQ ID NO: 95119
  derived and/or modified sequence opt2 from hemagglutinin__InfluenzaA__ACZ05480

SEQ ID NO: 95123 - RNA, 1701 nt, Artificial Sequence; identical to SEQ ID NO: 94923
  derived and/or modified sequence opt2 from hemagglutinin__InfluenzaA__ACZ05513

SEQ ID NO: 95124 - RNA, 1701 nt, Artificial Sequence; identical to SEQ ID NO: 95100
  derived and/or modified sequence opt2 from hemagglutinin__InfluenzaA__ACZ05524

SEQ ID NO: 95125 - RNA, 1701 nt, Artificial Sequence
  derived and/or modified sequence opt2 from hemagglutinin__InfluenzaA__ACZ05535
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95126 - RNA, 1701 nt, Artificial Sequence; identical to SEQ ID NO: 95125
  derived and/or modified sequence opt2 from hemagglutinin__InfluenzaA__ACZ05546

SEQ ID NO: 95127 - RNA, 1701 nt, Artificial Sequence; identical to SEQ ID NO: 95100
  derived and/or modified sequence opt2 from hemagglutinin__InfluenzaA__ACZ05557

SEQ ID NO: 95128 - RNA, 1698 nt, Artificial Sequence
  derived and/or modified sequence opt2 from hemagglutinin__InfluenzaA__ACZ05579
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95129 - RNA, 1698 nt, Artificial Sequence
  derived and/or modified sequence opt2 from hemagglutinin__InfluenzaA__ACZ05590
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgaggacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95130 - RNA, 1701 nt, Artificial Sequence; identical to SEQ ID NO: 95125
  derived and/or modified sequence opt2 from hemagglutinin__InfluenzaA__ACZ05950

SEQ ID NO: 95131 - RNA, 1701 nt, Artificial Sequence; identical to SEQ ID NO: 95100
  derived and/or modified sequence opt2 from hemagglutinin__InfluenzaA__ACZ05961

SEQ ID NO: 95132 - RNA, 1701 nt, Artificial Sequence
  derived and/or modified sequence opt2 from hemagglutinin__InfluenzaA__ACZ05972
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcucccuccucugcgucgcccuccucggcuucaucaugugggccugccagaagggcaacauccgcugcaacaucugcaucuga

SEQ ID NO: 95133 - RNA, 1701 nt, Artificial Sequence
  derived and/or modified sequence opt2 from hemagglutinin__InfluenzaA__ACZ05983
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaacaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95134 - RNA, 1701 nt, Artificial Sequence
  derived and/or modified sequence opt2 from hemagglutinin__InfluenzaA__ACZ05994
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccguccccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95135 - RNA, 1701 nt, Artificial Sequence; identical to SEQ ID NO: 95100
  derived and/or modified sequence opt2 from hemagglutinin__InfluenzaA__ACZ06005

SEQ ID NO: 95136 - RNA, 1701 nt, Artificial Sequence; identical to SEQ ID NO: 95100
  derived and/or modified sequence opt2 from hemagglutinin__InfluenzaA__ACZ06016

SEQ ID NO: 95137 - RNA, 1698 nt, Artificial Sequence
  derived and/or modified sequence opt2 from hemagglutinin__InfluenzaA__ACZ16013
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaaggccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95138 - RNA, 1698 nt, Artificial Sequence
  derived and/or modified sequence opt2 from hemagglutinin__InfluenzaA__ACZ16023
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95139 - RNA, 1698 nt, Artificial Sequence
  derived and/or modified sequence opt2 from hemagglutinin__InfluenzaA__ACZ16033
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaacaaggagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95140 - RNA, 1701 nt, Artificial Sequence; identical to SEQ ID NO: 94168
  derived and/or modified sequence opt2 from hemagglutinin__InfluenzaA__ACZ16040

SEQ ID NO: 95141 - RNA, 1701 nt, Artificial Sequence; identical to SEQ ID NO: 94168
  derived and/or modified sequence opt2 from hemagglutinin__InfluenzaA__ACZ16050

SEQ ID NO: 95142 - RNA, 1701 nt, Artificial Sequence; identical to SEQ ID NO: 94168
  derived and/or modified sequence opt2 from hemagglutinin__InfluenzaA__ACZ16060

SEQ ID NO: 95143 - RNA, 1701 nt, Artificial Sequence
  derived and/or modified sequence opt2 from hemagglutinin__InfluenzaA__ACZ16070
augaaggccauccucgucguccuccucuacaccuucgccaccgccaacgccgacacccucugcaucggcuaccacgccaacaacuccaccgacaccgucgacaccguccucgagaagaacgucaccgucacccacuccgucucccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95144 - RNA, 1701 nt, Artificial Sequence
  derived and/or modified sequence opt2 from hemagglutinin__InfluenzaA__ACZ16080
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgacggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95145 - RNA, 1701 nt, Artificial Sequence
  derived and/or modified sequence opt2 from hemagglutinin__InfluenzaA__ACZ16090
augaaggccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccauguccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95146 - RNA, 1701 nt, Artificial Sequence; identical to SEQ ID NO: 94168
  derived and/or modified sequence opt2 from hemagglutinin__InfluenzaA__ACZ16100

SEQ ID NO: 95147 - RNA, 1701 nt, Artificial Sequence; identical to SEQ ID NO: 94168
  derived and/or modified sequence opt2 from hemagglutinin__InfluenzaA__ACZ16110

SEQ ID NO: 95148 - RNA, 1701 nt, Artificial Sequence; identical to SEQ ID NO: 94168
  derived and/or modified sequence opt2 from hemagglutinin__InfluenzaA__ACZ16120

SEQ ID NO: 95149 - RNA, 1701 nt, Artificial Sequence; identical to SEQ ID NO: 94916
  derived and/or modified sequence opt2 from hemagglutinin__InfluenzaA__ACZ16130

SEQ ID NO: 95150 - RNA, 1701 nt, Artificial Sequence; identical to SEQ ID NO: 94168
  derived and/or modified sequence opt2 from hemagglutinin__InfluenzaA__ACZ16140

SEQ ID NO: 95151 - RNA, 1701 nt, Artificial Sequence; identical to SEQ ID NO: 94168
  derived and/or modified sequence opt2 from hemagglutinin__InfluenzaA__ACZ16150

SEQ ID NO: 95152 - RNA, 1701 nt, Artificial Sequence; identical to SEQ ID NO: 94168
  derived and/or modified sequence opt2 from hemagglutinin__InfluenzaA__ACZ16160

SEQ ID NO: 95153 - RNA, 1701 nt, Artificial Sequence; identical to SEQ ID NO: 94361
  derived and/or modified sequence opt2 from hemagglutinin__InfluenzaA__ACZ16170

SEQ ID NO: 95154 - RNA, 1701 nt, Artificial Sequence
  derived and/or modified sequence opt2 from hemagglutinin__InfluenzaA__ACZ16180
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuacaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95155 - RNA, 1701 nt, Artificial Sequence; identical to SEQ ID NO: 94168
  derived and/or modified sequence opt2 from hemagglutinin__InfluenzaA__ACZ16190

SEQ ID NO: 95156 - RNA, 1701 nt, Artificial Sequence
  derived and/or modified sequence opt2 from hemagglutinin__InfluenzaA__ACZ16200
augaaggccauccucgucguccuccucuacaccuucgccaccgccaaccccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95157 - RNA, 1701 nt, Artificial Sequence; identical to SEQ ID NO: 94168
  derived and/or modified sequence opt2 from hemagglutinin__InfluenzaA__ACZ16210

SEQ ID NO: 95158 - RNA, 1701 nt, Artificial Sequence; identical to SEQ ID NO: 94168
  derived and/or modified sequence opt2 from hemagglutinin__InfluenzaA__ACZ16220

SEQ ID NO: 95159 - RNA, 1701 nt, Artificial Sequence; identical to SEQ ID NO: 94916
  derived and/or modified sequence opt2 from hemagglutinin__InfluenzaA__ACZ16230

SEQ ID NO: 95160 - RNA, 1701 nt, Artificial Sequence
  derived and/or modified sequence opt2 from hemagglutinin__InfluenzaA__ACZ16240
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgcccucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95161 - RNA, 1701 nt, Artificial Sequence; identical to SEQ ID NO: 94168
  derived and/or modified sequence opt2 from hemagglutinin__InfluenzaA__ACZ16260

SEQ ID NO: 95162 - RNA, 1701 nt, Artificial Sequence
  derived and/or modified sequence opt2 from hemagglutinin__InfluenzaA__ACZ16270
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagaaccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 95163 - RNA, 1701 nt, Artificial Sequence; identical to SEQ ID NO: 94843
  derived and/or modified sequence opt2 from hemagglutinin__InfluenzaA__ACZ16280

SEQ ID NO: 95164 - RNA, 1701 nt, Artificial Sequence; identical to SEQ ID NO: 94168
  derived and/or modified sequence opt2 from hemagglutinin__InfluenzaA__ACZ16290

SEQ ID NO: 95165 - RNA, 1701 nt, Artificial Sequence
  derived and/or modified sequence opt2 from hemagglutinin__InfluenzaA__ACZ16300
augaaggccauccucgucguccuccucuacaccuucgccaccgccaacgccgacacccucugcaucggcuaccacgccaacaacuccaccgacaccgucgacaccguccucgagaagaacgucaucgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95166 - RNA, 1701 nt, Artificial Sequence; identical to SEQ ID NO: 94911
  derived and/or modified sequence opt2 from hemagglutinin__InfluenzaA__ACZ16310

SEQ ID NO: 95167 - RNA, 1701 nt, Artificial Sequence
  derived and/or modified sequence opt2 from hemagglutinin__InfluenzaA__ACZ16320
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccacccgccuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95168 - RNA, 1701 nt, Artificial Sequence; identical to SEQ ID NO: 94911
  derived and/or modified sequence opt2 from hemagglutinin__InfluenzaA__ACZ16330

SEQ ID NO: 95169 - RNA, 1701 nt, Artificial Sequence; identical to SEQ ID NO: 94361
  derived and/or modified sequence opt2 from hemagglutinin__InfluenzaA__ACZ16340

SEQ ID NO: 95170 - RNA, 1701 nt, Artificial Sequence; identical to SEQ ID NO: 94168
  derived and/or modified sequence opt2 from hemagglutinin__InfluenzaA__ACZ16350

SEQ ID NO: 95171 - RNA, 1701 nt, Artificial Sequence; identical to SEQ ID NO: 94168
  derived and/or modified sequence opt2 from hemagglutinin__InfluenzaA__ACZ16360

SEQ ID NO: 95172 - RNA, 1701 nt, Artificial Sequence; identical to SEQ ID NO: 94361
  derived and/or modified sequence opt2 from hemagglutinin__InfluenzaA__ACZ16370

SEQ ID NO: 95173 - RNA, 1701 nt, Artificial Sequence; identical to SEQ ID NO: 94168
  derived and/or modified sequence opt2 from hemagglutinin__InfluenzaA__ACZ16380

SEQ ID NO: 95174 - RNA, 1701 nt, Artificial Sequence; identical to SEQ ID NO: 94168
  derived and/or modified sequence opt2 from hemagglutinin__InfluenzaA__ACZ16390

SEQ ID NO: 95175 - RNA, 1701 nt, Artificial Sequence; identical to SEQ ID NO: 94168
  derived and/or modified sequence opt2 from hemagglutinin__InfluenzaA__ACZ16400

SEQ ID NO: 95176 - RNA, 1701 nt, Artificial Sequence; identical to SEQ ID NO: 94168
  derived and/or modified sequence opt2 from hemagglutinin__InfluenzaA__ACZ16410

SEQ ID NO: 95177 - RNA, 1701 nt, Artificial Sequence; identical to SEQ ID NO: 94805
  derived and/or modified sequence opt2 from hemagglutinin__InfluenzaA__ACZ16420

SEQ ID NO: 95178 - RNA, 1701 nt, Artificial Sequence; identical to SEQ ID NO: 94168
  derived and/or modified sequence opt2 from hemagglutinin__InfluenzaA__ACZ16430

SEQ ID NO: 95179 - RNA, 1701 nt, Artificial Sequence; identical to SEQ ID NO: 94168
  derived and/or modified sequence opt2 from hemagglutinin__InfluenzaA__ACZ16440

SEQ ID NO: 95180 - RNA, 1701 nt, Artificial Sequence
  derived and/or modified sequence opt2 from hemagglutinin__InfluenzaA__ACZ16450
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95181 - RNA, 1701 nt, Artificial Sequence; identical to SEQ ID NO: 94361
  derived and/or modified sequence opt2 from hemagglutinin__InfluenzaA__ACZ16460

SEQ ID NO: 95182 - RNA, 1701 nt, Artificial Sequence; identical to SEQ ID NO: 94168
  derived and/or modified sequence opt2 from hemagglutinin__InfluenzaA__ACZ16470

SEQ ID NO: 95183 - RNA, 1701 nt, Artificial Sequence; identical to SEQ ID NO: 94168
  derived and/or modified sequence opt2 from hemagglutinin__InfluenzaA__ACZ16480

SEQ ID NO: 95184 - RNA, 1701 nt, Artificial Sequence; identical to SEQ ID NO: 94916
  derived and/or modified sequence opt2 from hemagglutinin__InfluenzaA__ACZ16490

SEQ ID NO: 95185 - RNA, 1701 nt, Artificial Sequence; identical to SEQ ID NO: 94168
  derived and/or modified sequence opt2 from hemagglutinin__InfluenzaA__ACZ16500

SEQ ID NO: 95186 - RNA, 1701 nt, Artificial Sequence; identical to SEQ ID NO: 94361
  derived and/or modified sequence opt2 from hemagglutinin__InfluenzaA__ACZ16510

SEQ ID NO: 95187 - RNA, 1701 nt, Artificial Sequence; identical to SEQ ID NO: 94168
  derived and/or modified sequence opt2 from hemagglutinin__InfluenzaA__ACZ16530

SEQ ID NO: 95188 - RNA, 1701 nt, Artificial Sequence
  derived and/or modified sequence opt2 from hemagglutinin__InfluenzaA__ACZ16540
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccuccucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95189 - RNA, 1701 nt, Artificial Sequence; identical to SEQ ID NO: 94911
  derived and/or modified sequence opt2 from hemagglutinin__InfluenzaA__ACZ16550

SEQ ID NO: 95190 - RNA, 1701 nt, Artificial Sequence; identical to SEQ ID NO: 94168
  derived and/or modified sequence opt2 from hemagglutinin__InfluenzaA__ACZ16583

SEQ ID NO: 95191 - RNA, 1701 nt, Artificial Sequence; identical to SEQ ID NO: 94911
  derived and/or modified sequence opt2 from hemagglutinin__InfluenzaA__ACZ16593

SEQ ID NO: 95192 - RNA, 1701 nt, Artificial Sequence; identical to SEQ ID NO: 94168
  derived and/or modified sequence opt2 from hemagglutinin__InfluenzaA__ACZ16603

SEQ ID NO: 95193 - RNA, 1701 nt, Artificial Sequence; identical to SEQ ID NO: 94911
  derived and/or modified sequence opt2 from hemagglutinin__InfluenzaA__ACZ16630

SEQ ID NO: 95194 - RNA, 1701 nt, Artificial Sequence; identical to SEQ ID NO: 94168
  derived and/or modified sequence opt2 from hemagglutinin__InfluenzaA__ACZ16640

SEQ ID NO: 95195 - RNA, 1701 nt, Artificial Sequence; identical to SEQ ID NO: 94168
  derived and/or modified sequence opt2 from hemagglutinin__InfluenzaA__ACZ16650

SEQ ID NO: 95196 - RNA, 1701 nt, Artificial Sequence; identical to SEQ ID NO: 94168
  derived and/or modified sequence opt2 from hemagglutinin__InfluenzaA__ACZ16660

SEQ ID NO: 95197 - RNA, 1701 nt, Artificial Sequence; identical to SEQ ID NO: 94168
  derived and/or modified sequence opt2 from hemagglutinin__InfluenzaA__ACZ16670

SEQ ID NO: 95198 - RNA, 1701 nt, Artificial Sequence; identical to SEQ ID NO: 94168
  derived and/or modified sequence opt2 from hemagglutinin__InfluenzaA__ACZ16680

SEQ ID NO: 95199 - RNA, 1701 nt, Artificial Sequence; identical to SEQ ID NO: 94168
  derived and/or modified sequence opt2 from hemagglutinin__InfluenzaA__ACZ16690

SEQ ID NO: 95200 - RNA, 1701 nt, Artificial Sequence; identical to SEQ ID NO: 94168
  derived and/or modified sequence opt2 from hemagglutinin__InfluenzaA__ACZ16700

SEQ ID NO: 95201 - RNA, 1701 nt, Artificial Sequence; identical to SEQ ID NO: 94168
  derived and/or modified sequence opt2 from hemagglutinin__InfluenzaA__ACZ16710

SEQ ID NO: 95202 - RNA, 1701 nt, Artificial Sequence; identical to SEQ ID NO: 94168
  derived and/or modified sequence opt2 from hemagglutinin__InfluenzaA__ACZ16720

SEQ ID NO: 95203 - RNA, 1701 nt, Artificial Sequence; identical to SEQ ID NO: 94911
  derived and/or modified sequence opt2 from hemagglutinin__InfluenzaA__ACZ16730

SEQ ID NO: 95204 - RNA, 1701 nt, Artificial Sequence; identical to SEQ ID NO: 94911
  derived and/or modified sequence opt2 from hemagglutinin__InfluenzaA__ACZ16740

SEQ ID NO: 95205 - RNA, 1701 nt, Artificial Sequence; identical to SEQ ID NO: 94168
  derived and/or modified sequence opt2 from hemagglutinin__InfluenzaA__ACZ16750

SEQ ID NO: 95206 - RNA, 1701 nt, Artificial Sequence; identical to SEQ ID NO: 94168
  derived and/or modified sequence opt2 from hemagglutinin__InfluenzaA__ACZ16760

SEQ ID NO: 95207 - RNA, 1701 nt, Artificial Sequence; identical to SEQ ID NO: 94361
  derived and/or modified sequence opt2 from hemagglutinin__InfluenzaA__ACZ16770

SEQ ID NO: 95208 - RNA, 1701 nt, Artificial Sequence; identical to SEQ ID NO: 94168
  derived and/or modified sequence opt2 from hemagglutinin__InfluenzaA__ACZ16780

SEQ ID NO: 95209 - RNA, 1701 nt, Artificial Sequence; identical to SEQ ID NO: 94168
  derived and/or modified sequence opt2 from hemagglutinin__InfluenzaA__ACZ16790

SEQ ID NO: 95210 - RNA, 1701 nt, Artificial Sequence; identical to SEQ ID NO: 94168
  derived and/or modified sequence opt2 from hemagglutinin__InfluenzaA__ACZ16800

SEQ ID NO: 95211 - RNA, 1701 nt, Artificial Sequence; identical to SEQ ID NO: 94168
  derived and/or modified sequence opt2 from hemagglutinin__InfluenzaA__ACZ16810

SEQ ID NO: 95212 - RNA, 1701 nt, Artificial Sequence; identical to SEQ ID NO: 94843
  derived and/or modified sequence opt2 from hemagglutinin__InfluenzaA__ACZ16820

SEQ ID NO: 95213 - RNA, 1701 nt, Artificial Sequence; identical to SEQ ID NO: 94168
  derived and/or modified sequence opt2 from hemagglutinin__InfluenzaA__ACZ16830

SEQ ID NO: 95214 - RNA, 1701 nt, Artificial Sequence
  derived and/or modified sequence opt2 from hemagglutinin__InfluenzaA__ACZ16840
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgcaccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95215 - RNA, 1701 nt, Artificial Sequence; identical to SEQ ID NO: 94168
  derived and/or modified sequence opt2 from hemagglutinin__InfluenzaA__ACZ16850

SEQ ID NO: 95216 - RNA, 1701 nt, Artificial Sequence
  derived and/or modified sequence opt2 from hemagglutinin__InfluenzaA__ACZ16860
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95217 - RNA, 1701 nt, Artificial Sequence; identical to SEQ ID NO: 94911
  derived and/or modified sequence opt2 from hemagglutinin__InfluenzaA__ACZ16870

SEQ ID NO: 95218 - RNA, 1701 nt, Artificial Sequence
  derived and/or modified sequence opt2 from hemagglutinin__InfluenzaA__ACZ16880
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgacggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95219 - RNA, 1701 nt, Artificial Sequence; identical to SEQ ID NO: 94916
  derived and/or modified sequence opt2 from hemagglutinin__InfluenzaA__ACZ16890

SEQ ID NO: 95220 - RNA, 1701 nt, Artificial Sequence; identical to SEQ ID NO: 94168
  derived and/or modified sequence opt2 from hemagglutinin__InfluenzaA__ACZ16900

SEQ ID NO: 95221 - RNA, 1701 nt, Artificial Sequence; identical to SEQ ID NO: 94168
  derived and/or modified sequence opt2 from hemagglutinin__InfluenzaA__ACZ16910

SEQ ID NO: 95222 - RNA, 1701 nt, Artificial Sequence; identical to SEQ ID NO: 94168
  derived and/or modified sequence opt2 from hemagglutinin__InfluenzaA__ACZ16920

SEQ ID NO: 95223 - RNA, 1701 nt, Artificial Sequence; identical to SEQ ID NO: 94181
  derived and/or modified sequence opt2 from hemagglutinin__InfluenzaA__ACZ16930

SEQ ID NO: 95224 - RNA, 1701 nt, Artificial Sequence; identical to SEQ ID NO: 94181
  derived and/or modified sequence opt2 from hemagglutinin__InfluenzaA__ACZ16940

SEQ ID NO: 95225 - RNA, 1701 nt, Artificial Sequence; identical to SEQ ID NO: 94168
  derived and/or modified sequence opt2 from hemagglutinin__InfluenzaA__ACZ16950

SEQ ID NO: 95226 - RNA, 1701 nt, Artificial Sequence; identical to SEQ ID NO: 94423
  derived and/or modified sequence opt2 from hemagglutinin__InfluenzaA__ACZ16960

SEQ ID NO: 95227 - RNA, 1701 nt, Artificial Sequence
  derived and/or modified sequence opt2 from hemagglutinin__InfluenzaA__ACZ16970
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95228 - RNA, 1701 nt, Artificial Sequence; identical to SEQ ID NO: 94181
  derived and/or modified sequence opt2 from hemagglutinin__InfluenzaA__ACZ16980

SEQ ID NO: 95229 - RNA, 1701 nt, Artificial Sequence; identical to SEQ ID NO: 94181
  derived and/or modified sequence opt2 from hemagglutinin__InfluenzaA__ACZ17000

SEQ ID NO: 95230 - RNA, 1701 nt, Artificial Sequence
  derived and/or modified sequence opt2 from hemagglutinin__InfluenzaA__ACZ17010
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95231 - RNA, 1701 nt, Artificial Sequence; identical to SEQ ID NO: 94181
  derived and/or modified sequence opt2 from hemagglutinin__InfluenzaA__ACZ17020

SEQ ID NO: 95232 - RNA, 1701 nt, Artificial Sequence
  derived and/or modified sequence opt2 from hemagglutinin__InfluenzaA__ACZ17030
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgaggccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95233 - RNA, 1701 nt, Artificial Sequence
  derived and/or modified sequence opt2 from hemagglutinin__InfluenzaA__ACZ17040
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95234 - RNA, 1701 nt, Artificial Sequence; identical to SEQ ID NO: 94181
  derived and/or modified sequence opt2 from hemagglutinin__InfluenzaA__ACZ17050

SEQ ID NO: 95235 - RNA, 1701 nt, Artificial Sequence; identical to SEQ ID NO: 94181
  derived and/or modified sequence opt2 from hemagglutinin__InfluenzaA__ACZ17060

SEQ ID NO: 95236 - RNA, 1701 nt, Artificial Sequence; identical to SEQ ID NO: 94181
  derived and/or modified sequence opt2 from hemagglutinin__InfluenzaA__ACZ17070

SEQ ID NO: 95237 - RNA, 1701 nt, Artificial Sequence; identical to SEQ ID NO: 94361
  derived and/or modified sequence opt2 from hemagglutinin__InfluenzaA__ACZ17080

SEQ ID NO: 95238 - RNA, 1701 nt, Artificial Sequence
  derived and/or modified sequence opt2 from hemagglutinin__InfluenzaA__ACZ17090
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucggcgacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95239 - RNA, 1701 nt, Artificial Sequence; identical to SEQ ID NO: 94168
  derived and/or modified sequence opt2 from hemagglutinin__InfluenzaA__ACZ17100

SEQ ID NO: 95240 - RNA, 1701 nt, Artificial Sequence
  derived and/or modified sequence opt2 from hemagglutinin__InfluenzaA__ACZ17110
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccgagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95241 - RNA, 1701 nt, Artificial Sequence
  derived and/or modified sequence opt2 from hemagglutinin__InfluenzaA__ACZ17120
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95242 - RNA, 1701 nt, Artificial Sequence
  derived and/or modified sequence opt2 from hemagglutinin__InfluenzaA__ACZ17130
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacgcccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95243 - RNA, 1701 nt, Artificial Sequence; identical to SEQ ID NO: 94979
  derived and/or modified sequence opt2 from hemagglutinin__InfluenzaA__ACZ17140

SEQ ID NO: 95244 - RNA, 1701 nt, Artificial Sequence; identical to SEQ ID NO: 94810
  derived and/or modified sequence opt2 from hemagglutinin__InfluenzaA__ACZ17150

SEQ ID NO: 95245 - RNA, 1701 nt, Artificial Sequence; identical to SEQ ID NO: 94810
  derived and/or modified sequence opt2 from hemagglutinin__InfluenzaA__ACZ17160

SEQ ID NO: 95246 - RNA, 1701 nt, Artificial Sequence; identical to SEQ ID NO: 94810
  derived and/or modified sequence opt2 from hemagglutinin__InfluenzaA__ACZ17170

SEQ ID NO: 95247 - RNA, 1701 nt, Artificial Sequence
  derived and/or modified sequence opt2 from hemagglutinin__InfluenzaA__ACZ17190
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcuccaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95248 - RNA, 1701 nt, Artificial Sequence; identical to SEQ ID NO: 95247
  derived and/or modified sequence opt2 from hemagglutinin__InfluenzaA__ACZ17200

SEQ ID NO: 95249 - RNA, 1701 nt, Artificial Sequence; identical to SEQ ID NO: 94181
  derived and/or modified sequence opt2 from hemagglutinin__InfluenzaA__ACZ17220

SEQ ID NO: 95250 - RNA, 1701 nt, Artificial Sequence
  derived and/or modified sequence opt2 from hemagglutinin__InfluenzaA__ACZ17230
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcucaaggagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95251 - RNA, 1701 nt, Artificial Sequence; identical to SEQ ID NO: 94181
  derived and/or modified sequence opt2 from hemagglutinin__InfluenzaA__ACZ17240

SEQ ID NO: 95252 - RNA, 1701 nt, Artificial Sequence; identical to SEQ ID NO: 94181
  derived and/or modified sequence opt2 from hemagglutinin__InfluenzaA__ACZ17250

SEQ ID NO: 95253 - RNA, 1701 nt, Artificial Sequence; identical to SEQ ID NO: 94181
  derived and/or modified sequence opt2 from hemagglutinin__InfluenzaA__ACZ17260

SEQ ID NO: 95254 - RNA, 1701 nt, Artificial Sequence
  derived and/or modified sequence opt2 from hemagglutinin__InfluenzaA__ACZ17270
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggccgcugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 95255 - RNA, 1701 nt, Artificial Sequence; identical to SEQ ID NO: 94361
  derived and/or modified sequence opt2 from hemagglutinin__InfluenzaA__ACZ17290

SEQ ID NO: 95256 - RNA, 1701 nt, Artificial Sequence; identical to SEQ ID NO: 94361
  derived and/or modified sequence opt2 from hemagglutinin__InfluenzaA__ACZ17300

SEQ ID NO: 95257 - RNA, 1701 nt, Artificial Sequence; identical to SEQ ID NO: 94361
  derived and/or modified sequence opt2 from hemagglutinin__InfluenzaA__ACZ17310

SEQ ID NO: 95258 - RNA, 1701 nt, Artificial Sequence; identical to SEQ ID NO: 94181
  derived and/or modified sequence opt2 from hemagglutinin__InfluenzaA__ACZ17398

SEQ ID NO: 95259 - RNA, 1701 nt, Artificial Sequence; identical to SEQ ID NO: 94181
  derived and/or modified sequence opt2 from hemagglutinin__InfluenzaA__ACZ17408

SEQ ID NO: 95260 - RNA, 1701 nt, Artificial Sequence; identical to SEQ ID NO: 94181
  derived and/or modified sequence opt2 from hemagglutinin__InfluenzaA__ACZ17418

SEQ ID NO: 95261 - RNA, 1701 nt, Artificial Sequence
  derived and/or modified sequence opt2 from hemagglutinin__InfluenzaA__ACZ17438
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95262 - RNA, 1701 nt, Artificial Sequence; identical to SEQ ID NO: 94168
  derived and/or modified sequence opt2 from hemagglutinin__InfluenzaA__ACZ17448

SEQ ID NO: 95263 - RNA, 1701 nt, Artificial Sequence; identical to SEQ ID NO: 94181
  derived and/or modified sequence opt2 from hemagglutinin__InfluenzaA__ACZ17458

SEQ ID NO: 95264 - RNA, 1701 nt, Artificial Sequence; identical to SEQ ID NO: 94168
  derived and/or modified sequence opt2 from hemagglutinin__InfluenzaA__ACZ17478

SEQ ID NO: 95265 - RNA, 1701 nt, Artificial Sequence; identical to SEQ ID NO: 94181
  derived and/or modified sequence opt2 from hemagglutinin__InfluenzaA__ACZ17488

SEQ ID NO: 95266 - RNA, 1701 nt, Artificial Sequence
  derived and/or modified sequence opt2 from hemagglutinin__InfluenzaA__ACZ18240
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95267 - RNA, 1701 nt, Artificial Sequence; identical to SEQ ID NO: 94181
  derived and/or modified sequence opt2 from hemagglutinin__InfluenzaA__ACZ18241

SEQ ID NO: 95268 - RNA, 1701 nt, Artificial Sequence
  derived and/or modified sequence opt2 from hemagglutinin__InfluenzaA__ACZ27800
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaaggaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95269 - RNA, 1701 nt, Artificial Sequence; identical to SEQ ID NO: 94181
  derived and/or modified sequence opt2 from hemagglutinin__InfluenzaA__ACZ27810

SEQ ID NO: 95270 - RNA, 1701 nt, Artificial Sequence; identical to SEQ ID NO: 94181
  derived and/or modified sequence opt2 from hemagglutinin__InfluenzaA__ACZ27820

SEQ ID NO: 95271 - RNA, 1701 nt, Artificial Sequence; identical to SEQ ID NO: 94181
  derived and/or modified sequence opt2 from hemagglutinin__InfluenzaA__ACZ27830

SEQ ID NO: 95272 - RNA, 1701 nt, Artificial Sequence; identical to SEQ ID NO: 94534
  derived and/or modified sequence opt2 from hemagglutinin__InfluenzaA__ACZ27840

SEQ ID NO: 95273 - RNA, 1701 nt, Artificial Sequence; identical to SEQ ID NO: 94168
  derived and/or modified sequence opt2 from hemagglutinin__InfluenzaA__ACZ45006

SEQ ID NO: 95274 - RNA, 1701 nt, Artificial Sequence
  derived and/or modified sequence opt2 from hemagglutinin__InfluenzaA__ACZ45007
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcgacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95275 - RNA, 1701 nt, Artificial Sequence; identical to SEQ ID NO: 94534
  derived and/or modified sequence opt2 from hemagglutinin__InfluenzaA__ACZ45008

SEQ ID NO: 95276 - RNA, 1701 nt, Artificial Sequence; identical to SEQ ID NO: 94534
  derived and/or modified sequence opt2 from hemagglutinin__InfluenzaA__ACZ45009

SEQ ID NO: 95277 - RNA, 1701 nt, Artificial Sequence; identical to SEQ ID NO: 94423
  derived and/or modified sequence opt2 from hemagglutinin__InfluenzaA__ACZ45010

SEQ ID NO: 95278 - RNA, 1701 nt, Artificial Sequence; identical to SEQ ID NO: 94181
  derived and/or modified sequence opt2 from hemagglutinin__InfluenzaA__ACZ45012

SEQ ID NO: 95279 - RNA, 1701 nt, Artificial Sequence
  derived and/or modified sequence opt2 from hemagglutinin__InfluenzaA__ACZ45013
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccuccaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95280 - RNA, 1701 nt, Artificial Sequence; identical to SEQ ID NO: 94181
  derived and/or modified sequence opt2 from hemagglutinin__InfluenzaA__ACZ45014

SEQ ID NO: 95281 - RNA, 1701 nt, Artificial Sequence; identical to SEQ ID NO: 94181
  derived and/or modified sequence opt2 from hemagglutinin__InfluenzaA__ACZ45016

SEQ ID NO: 95282 - RNA, 1701 nt, Artificial Sequence
  derived and/or modified sequence opt2 from hemagglutinin__InfluenzaA__ACZ45028
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95283 - RNA, 1701 nt, Artificial Sequence
  derived and/or modified sequence opt2 from hemagglutinin__InfluenzaA__ACZ45029
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95284 - RNA, 1701 nt, Artificial Sequence
  derived and/or modified sequence opt2 from hemagglutinin__InfluenzaA__ACZ45030
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaccuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95285 - RNA, 1701 nt, Artificial Sequence
  derived and/or modified sequence opt2 from hemagglutinin__InfluenzaA__ACZ45031
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucaccauggagcgcaacgucggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95286 - RNA, 1701 nt, Artificial Sequence
  derived and/or modified sequence opt2 from hemagglutinin__InfluenzaA__ACZ45034
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacgucccccccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95287 - RNA, 1701 nt, Artificial Sequence; identical to SEQ ID NO: 94181
  derived and/or modified sequence opt2 from hemagglutinin__InfluenzaA__ACZ45036

SEQ ID NO: 95288 - RNA, 1701 nt, Artificial Sequence; identical to SEQ ID NO: 94181
  derived and/or modified sequence opt2 from hemagglutinin__InfluenzaA__ACZ45037

SEQ ID NO: 95289 - RNA, 1701 nt, Artificial Sequence; identical to SEQ ID NO: 95282
  derived and/or modified sequence opt2 from hemagglutinin__InfluenzaA__ACZ45038

SEQ ID NO: 95290 - RNA, 1701 nt, Artificial Sequence; identical to SEQ ID NO: 94534
  derived and/or modified sequence opt2 from hemagglutinin__InfluenzaA__ACZ45039

SEQ ID NO: 95291 - RNA, 1701 nt, Artificial Sequence; identical to SEQ ID NO: 94181
  derived and/or modified sequence opt2 from hemagglutinin__InfluenzaA__ACZ45040

SEQ ID NO: 95292 - RNA, 1701 nt, Artificial Sequence; identical to SEQ ID NO: 94181
  derived and/or modified sequence opt2 from hemagglutinin__InfluenzaA__ACZ52567

SEQ ID NO: 95293 - RNA, 1701 nt, Artificial Sequence; identical to SEQ ID NO: 94181
  derived and/or modified sequence opt2 from hemagglutinin__InfluenzaA__ACZ52568

SEQ ID NO: 95294 - RNA, 1701 nt, Artificial Sequence; identical to SEQ ID NO: 94750
  derived and/or modified sequence opt2 from hemagglutinin__InfluenzaA__ACZ52569

SEQ ID NO: 95295 - RNA, 1701 nt, Artificial Sequence
  derived and/or modified sequence opt2 from hemagglutinin__InfluenzaA__ACZ53956
augaagaccaucaucgcccucuccuacaucuucugccucgcccucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucuccacccucaacuggcuccaccagcuccagaaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 95296 - RNA, 1701 nt, Artificial Sequence
  derived and/or modified sequence opt2 from hemagglutinin__InfluenzaA__ACZ53967
augaagaccaucaucgcccucuccuacaucuucugccucgcccucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucuccacccucaacuggcuccaccagcuccagaaccgcuaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacguccucgucaucaacuccaacggcaaccucaucgccccccgcggcuacuucaagaugcgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuccaucaugugggccugccagcgcggcaacauccgcugcaacaucugcaucuga

SEQ ID NO: 95297 - RNA, 1701 nt, Artificial Sequence
  derived and/or modified sequence opt2 from hemagglutinin__InfluenzaA__ACZ53978
augaagaccaucaucgcccucuccuacaucuucugccucgcccucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccucaagucccucaucgccuccuccggcacccucgaguucaacaacgaguccuucaacuggaucggcgucucccagaacggcaccuccuccgccugcaagcgcaucuccaucaccgucuccuucaacaagcucaacuggcuccaccagcucaaguaccgcuaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacguccucgucaucaacuccaacggcaaccucaucgccccccgcggcuacuucaagaugcgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 95298 - RNA, 1701 nt, Artificial Sequence
  derived and/or modified sequence opt2 from hemagglutinin__InfluenzaA__ACZ56080
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95299 - RNA, 1701 nt, Artificial Sequence
  derived and/or modified sequence opt2 from hemagglutinin__InfluenzaA__ACZ61118
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95300 - RNA, 1701 nt, Artificial Sequence
  derived and/or modified sequence opt2 from hemagglutinin__InfluenzaA__ACZ61119
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95301 - RNA, 1701 nt, Artificial Sequence; identical to SEQ ID NO: 94181
  derived and/or modified sequence opt2 from hemagglutinin__InfluenzaA__ACZ61122

SEQ ID NO: 95302 - RNA, 1701 nt, Artificial Sequence; identical to SEQ ID NO: 94181
  derived and/or modified sequence opt2 from hemagglutinin__InfluenzaA__ACZ61123

SEQ ID NO: 95303 - RNA, 1701 nt, Artificial Sequence; identical to SEQ ID NO: 94979
  derived and/or modified sequence opt2 from hemagglutinin__InfluenzaA__ACZ74627

SEQ ID NO: 95304 - RNA, 1698 nt, Artificial Sequence
  derived and/or modified sequence opt2 from hemagglutinin__InfluenzaA__ACZ81554
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacaaccacaacggcaagcucugccuccucaagggcaucgccccccuccagcucggcaacugcaccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagauccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95305 - RNA, 1698 nt, Artificial Sequence
  derived and/or modified sequence opt2 from hemagglutinin__InfluenzaA__ACZ81555
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacugggcccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95306 - RNA, 1698 nt, Artificial Sequence
  derived and/or modified sequence opt2 from hemagglutinin__InfluenzaA__ACZ81556
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaacaaggagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95307 - RNA, 1701 nt, Artificial Sequence
  derived and/or modified sequence opt2 from hemagglutinin__InfluenzaA__ACZ81557
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcggcuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccaggcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95308 - RNA, 1701 nt, Artificial Sequence
  derived and/or modified sequence opt2 from hemagglutinin__InfluenzaA__ACZ81558
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95309 - RNA, 1701 nt, Artificial Sequence
  derived and/or modified sequence opt2 from hemagglutinin__InfluenzaA__ACZ81559
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95310 - RNA, 1701 nt, Artificial Sequence; identical to SEQ ID NO: 94181
  derived and/or modified sequence opt2 from hemagglutinin__InfluenzaA__ACZ81632

SEQ ID NO: 95311 - RNA, 1701 nt, Artificial Sequence; identical to SEQ ID NO: 94181
  derived and/or modified sequence opt2 from hemagglutinin__InfluenzaA__ACZ81642

SEQ ID NO: 95312 - RNA, 1701 nt, Artificial Sequence
  derived and/or modified sequence opt2 from hemagglutinin__InfluenzaA__ACZ81652
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95313 - RNA, 1701 nt, Artificial Sequence
  derived and/or modified sequence opt2 from hemagglutinin__InfluenzaA__ACZ92130
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcaucgaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95314 - RNA, 1701 nt, Artificial Sequence; identical to SEQ ID NO: 94423
  derived and/or modified sequence opt2 from hemagglutinin__InfluenzaA__ACZ92131

SEQ ID NO: 95315 - RNA, 1701 nt, Artificial Sequence; identical to SEQ ID NO: 94423
  derived and/or modified sequence opt2 from hemagglutinin__InfluenzaA__ACZ92132

SEQ ID NO: 95316 - RNA, 1701 nt, Artificial Sequence; identical to SEQ ID NO: 94423
  derived and/or modified sequence opt2 from hemagglutinin__InfluenzaA__ACZ92133

SEQ ID NO: 95317 - RNA, 1701 nt, Artificial Sequence; identical to SEQ ID NO: 94181
  derived and/or modified sequence opt2 from hemagglutinin__InfluenzaA__ACZ92134

SEQ ID NO: 95318 - RNA, 1701 nt, Artificial Sequence; identical to SEQ ID NO: 94181
  derived and/or modified sequence opt2 from hemagglutinin__InfluenzaA__ACZ95465

SEQ ID NO: 95319 - RNA, 1701 nt, Artificial Sequence; identical to SEQ ID NO: 94168
  derived and/or modified sequence opt2 from hemagglutinin__InfluenzaA__ACZ95837

SEQ ID NO: 95320 - RNA, 1701 nt, Artificial Sequence; identical to SEQ ID NO: 94181
  derived and/or modified sequence opt2 from hemagglutinin__InfluenzaA__ACZ95847

SEQ ID NO: 95321 - RNA, 1701 nt, Artificial Sequence
  derived and/or modified sequence opt2 from hemagglutinin__InfluenzaA__ACZ95857
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95322 - RNA, 1701 nt, Artificial Sequence; identical to SEQ ID NO: 94181
  derived and/or modified sequence opt2 from hemagglutinin__InfluenzaA__ACZ95867

SEQ ID NO: 95323 - RNA, 1701 nt, Artificial Sequence
  derived and/or modified sequence opt2 from hemagglutinin__InfluenzaA__ACZ95887
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95324 - RNA, 1701 nt, Artificial Sequence; identical to SEQ ID NO: 94181
  derived and/or modified sequence opt2 from hemagglutinin__InfluenzaA__ACZ95897

SEQ ID NO: 95325 - RNA, 1701 nt, Artificial Sequence
  derived and/or modified sequence opt2 from hemagglutinin__InfluenzaA__ACZ95907
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucuacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95326 - RNA, 1701 nt, Artificial Sequence; identical to SEQ ID NO: 94181
  derived and/or modified sequence opt2 from hemagglutinin__InfluenzaA__ACZ95927

SEQ ID NO: 95327 - RNA, 1701 nt, Artificial Sequence
  derived and/or modified sequence opt2 from hemagglutinin__InfluenzaA__ACZ95937
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95328 - RNA, 1701 nt, Artificial Sequence; identical to SEQ ID NO: 94423
  derived and/or modified sequence opt2 from hemagglutinin__InfluenzaA__ACZ95947

SEQ ID NO: 95329 - RNA, 1701 nt, Artificial Sequence; identical to SEQ ID NO: 94181
  derived and/or modified sequence opt2 from hemagglutinin__InfluenzaA__ACZ95957

SEQ ID NO: 95330 - RNA, 1701 nt, Artificial Sequence; identical to SEQ ID NO: 94423
  derived and/or modified sequence opt2 from hemagglutinin__InfluenzaA__ACZ95967

SEQ ID NO: 95331 - RNA, 1701 nt, Artificial Sequence; identical to SEQ ID NO: 95327
  derived and/or modified sequence opt2 from hemagglutinin__InfluenzaA__ACZ95977

SEQ ID NO: 95332 - RNA, 1701 nt, Artificial Sequence
  derived and/or modified sequence opt2 from hemagglutinin__InfluenzaA__ACZ95987
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95333 - RNA, 1701 nt, Artificial Sequence; identical to SEQ ID NO: 94181
  derived and/or modified sequence opt2 from hemagglutinin__InfluenzaA__ACZ95997

SEQ ID NO: 95334 - RNA, 1701 nt, Artificial Sequence; identical to SEQ ID NO: 94181
  derived and/or modified sequence opt2 from hemagglutinin__InfluenzaA__ACZ96007

SEQ ID NO: 95335 - RNA, 1701 nt, Artificial Sequence; identical to SEQ ID NO: 94168
  derived and/or modified sequence opt2 from hemagglutinin__InfluenzaA__ACZ96017

SEQ ID NO: 95336 - RNA, 1701 nt, Artificial Sequence; identical to SEQ ID NO: 94181
  derived and/or modified sequence opt2 from hemagglutinin__InfluenzaA__ACZ96027

SEQ ID NO: 95337 - RNA, 1701 nt, Artificial Sequence; identical to SEQ ID NO: 95327
  derived and/or modified sequence opt2 from hemagglutinin__InfluenzaA__ACZ96047

SEQ ID NO: 95338 - RNA, 1701 nt, Artificial Sequence
  derived and/or modified sequence opt2 from hemagglutinin__InfluenzaA__ACZ96057
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95339 - RNA, 1701 nt, Artificial Sequence
  derived and/or modified sequence opt2 from hemagglutinin__InfluenzaA__ACZ96069
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcaacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95340 - RNA, 1701 nt, Artificial Sequence; identical to SEQ ID NO: 95327
  derived and/or modified sequence opt2 from hemagglutinin__InfluenzaA__ACZ96089

SEQ ID NO: 95341 - RNA, 1701 nt, Artificial Sequence
  derived and/or modified sequence opt2 from hemagglutinin__InfluenzaA__ACZ96119
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95342 - RNA, 1701 nt, Artificial Sequence
  derived and/or modified sequence opt2 from hemagglutinin__InfluenzaA__ACZ96129
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgaguucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95343 - RNA, 1701 nt, Artificial Sequence; identical to SEQ ID NO: 94181
  derived and/or modified sequence opt2 from hemagglutinin__InfluenzaA__ACZ96149

SEQ ID NO: 95344 - RNA, 1701 nt, Artificial Sequence; identical to SEQ ID NO: 94181
  derived and/or modified sequence opt2 from hemagglutinin__InfluenzaA__ACZ96159

SEQ ID NO: 95345 - RNA, 1701 nt, Artificial Sequence
  derived and/or modified sequence opt2 from hemagglutinin__InfluenzaA__ACZ96179
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95346 - RNA, 1701 nt, Artificial Sequence; identical to SEQ ID NO: 95338
  derived and/or modified sequence opt2 from hemagglutinin__InfluenzaA__ACZ96189

SEQ ID NO: 95347 - RNA, 1701 nt, Artificial Sequence; identical to SEQ ID NO: 95345
  derived and/or modified sequence opt2 from hemagglutinin__InfluenzaA__ACZ96199

SEQ ID NO: 95348 - RNA, 1701 nt, Artificial Sequence; identical to SEQ ID NO: 94181
  derived and/or modified sequence opt2 from hemagglutinin__InfluenzaA__ACZ96209

SEQ ID NO: 95349 - RNA, 1701 nt, Artificial Sequence
  derived and/or modified sequence opt2 from hemagglutinin__InfluenzaA__ACZ96219
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaaguucgaggccaccggcaaccucgucgucccccgcuacgccuucgccauggagcgcaacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgccggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95350 - RNA, 1701 nt, Artificial Sequence; identical to SEQ ID NO: 94181
  derived and/or modified sequence opt2 from hemagglutinin__InfluenzaA__ACZ96229

SEQ ID NO: 95351 - RNA, 1701 nt, Artificial Sequence; identical to SEQ ID NO: 95345
  derived and/or modified sequence opt2 from hemagglutinin__InfluenzaA__ACZ96239

SEQ ID NO: 95352 - RNA, 1701 nt, Artificial Sequence; identical to SEQ ID NO: 94181
  derived and/or modified sequence opt2 from hemagglutinin__InfluenzaA__ACZ96249

SEQ ID NO: 95353 - RNA, 1701 nt, Artificial Sequence
  derived and/or modified sequence opt2 from hemagglutinin__InfluenzaA__ACZ96269
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95354 - RNA, 1701 nt, Artificial Sequence; identical to SEQ ID NO: 94181
  derived and/or modified sequence opt2 from hemagglutinin__InfluenzaA__ACZ96299

SEQ ID NO: 95355 - RNA, 1701 nt, Artificial Sequence; identical to SEQ ID NO: 94181
  derived and/or modified sequence opt2 from hemagglutinin__InfluenzaA__ACZ96309

SEQ ID NO: 95356 - RNA, 1701 nt, Artificial Sequence
  derived and/or modified sequence opt2 from hemagglutinin__InfluenzaA__ACZ96319
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaucugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95357 - RNA, 1701 nt, Artificial Sequence; identical to SEQ ID NO: 95356
  derived and/or modified sequence opt2 from hemagglutinin__InfluenzaA__ACZ96329

SEQ ID NO: 95358 - RNA, 1701 nt, Artificial Sequence
  derived and/or modified sequence opt2 from hemagglutinin__InfluenzaA__ACZ96339
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucaagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95359 - RNA, 1701 nt, Artificial Sequence; identical to SEQ ID NO: 94181
  derived and/or modified sequence opt2 from hemagglutinin__InfluenzaA__ACZ96349

SEQ ID NO: 95360 - RNA, 1701 nt, Artificial Sequence; identical to SEQ ID NO: 95356
  derived and/or modified sequence opt2 from hemagglutinin__InfluenzaA__ACZ96359

SEQ ID NO: 95361 - RNA, 1701 nt, Artificial Sequence; identical to SEQ ID NO: 94181
  derived and/or modified sequence opt2 from hemagglutinin__InfluenzaA__ACZ96372

SEQ ID NO: 95362 - RNA, 1701 nt, Artificial Sequence; identical to SEQ ID NO: 95356
  derived and/or modified sequence opt2 from hemagglutinin__InfluenzaA__ACZ96382

SEQ ID NO: 95363 - RNA, 1701 nt, Artificial Sequence; identical to SEQ ID NO: 94168
  derived and/or modified sequence opt2 from hemagglutinin__InfluenzaA__ACZ96392

SEQ ID NO: 95364 - RNA, 1701 nt, Artificial Sequence; identical to SEQ ID NO: 94423
  derived and/or modified sequence opt2 from hemagglutinin__InfluenzaA__ACZ96405

SEQ ID NO: 95365 - RNA, 1701 nt, Artificial Sequence; identical to SEQ ID NO: 94181
  derived and/or modified sequence opt2 from hemagglutinin__InfluenzaA__ACZ96415

SEQ ID NO: 95366 - RNA, 1701 nt, Artificial Sequence; identical to SEQ ID NO: 94181
  derived and/or modified sequence opt2 from hemagglutinin__InfluenzaA__ACZ96425

SEQ ID NO: 95367 - RNA, 1701 nt, Artificial Sequence
  derived and/or modified sequence opt2 from hemagglutinin__InfluenzaA__ACZ96435
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgcccagcuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95368 - RNA, 1701 nt, Artificial Sequence; identical to SEQ ID NO: 94181
  derived and/or modified sequence opt2 from hemagglutinin__InfluenzaA__ACZ96445

SEQ ID NO: 95369 - RNA, 1701 nt, Artificial Sequence
  derived and/or modified sequence opt2 from hemagglutinin__InfluenzaA__ACZ96476
augaaggccauccucgucguccuccucuacaccuucgccaccgccuacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95370 - RNA, 1701 nt, Artificial Sequence; identical to SEQ ID NO: 94181
  derived and/or modified sequence opt2 from hemagglutinin__InfluenzaA__ACZ96496

SEQ ID NO: 95371 - RNA, 1701 nt, Artificial Sequence; identical to SEQ ID NO: 94181
  derived and/or modified sequence opt2 from hemagglutinin__InfluenzaA__ACZ96506

SEQ ID NO: 95372 - RNA, 1701 nt, Artificial Sequence; identical to SEQ ID NO: 94181
  derived and/or modified sequence opt2 from hemagglutinin__InfluenzaA__ACZ96526

SEQ ID NO: 95373 - RNA, 1701 nt, Artificial Sequence
  derived and/or modified sequence opt2 from hemagglutinin__InfluenzaA__ACZ96536
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaagcacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95374 - RNA, 1701 nt, Artificial Sequence; identical to SEQ ID NO: 94181
  derived and/or modified sequence opt2 from hemagglutinin__InfluenzaA__ACZ96549

SEQ ID NO: 95375 - RNA, 1701 nt, Artificial Sequence
  derived and/or modified sequence opt2 from hemagglutinin__InfluenzaA__ACZ96559
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95376 - RNA, 1701 nt, Artificial Sequence
  derived and/or modified sequence opt2 from hemagglutinin__InfluenzaA__ACZ96569
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95377 - RNA, 1701 nt, Artificial Sequence
  derived and/or modified sequence opt2 from hemagglutinin__InfluenzaA__ACZ96579
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccuccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95378 - RNA, 1701 nt, Artificial Sequence; identical to SEQ ID NO: 94181
  derived and/or modified sequence opt2 from hemagglutinin__InfluenzaA__ACZ96589

SEQ ID NO: 95379 - RNA, 1701 nt, Artificial Sequence
  derived and/or modified sequence opt2 from hemagglutinin__InfluenzaA__ACZ96599
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95380 - RNA, 1701 nt, Artificial Sequence
  derived and/or modified sequence opt2 from hemagglutinin__InfluenzaA__ACZ96609
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaccugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95381 - RNA, 1701 nt, Artificial Sequence; identical to SEQ ID NO: 94361
  derived and/or modified sequence opt2 from hemagglutinin__InfluenzaA__ACZ96619

SEQ ID NO: 95382 - RNA, 1701 nt, Artificial Sequence; identical to SEQ ID NO: 94361
  derived and/or modified sequence opt2 from hemagglutinin__InfluenzaA__ACZ96629

SEQ ID NO: 95383 - RNA, 1701 nt, Artificial Sequence; identical to SEQ ID NO: 94361
  derived and/or modified sequence opt2 from hemagglutinin__InfluenzaA__ACZ96639

SEQ ID NO: 95384 - RNA, 1701 nt, Artificial Sequence; identical to SEQ ID NO: 94361
  derived and/or modified sequence opt2 from hemagglutinin__InfluenzaA__ACZ96649

SEQ ID NO: 95385 - RNA, 1701 nt, Artificial Sequence; identical to SEQ ID NO: 94361
  derived and/or modified sequence opt2 from hemagglutinin__InfluenzaA__ACZ96659

SEQ ID NO: 95386 - RNA, 1701 nt, Artificial Sequence; identical to SEQ ID NO: 94361
  derived and/or modified sequence opt2 from hemagglutinin__InfluenzaA__ACZ96669

SEQ ID NO: 95387 - RNA, 1701 nt, Artificial Sequence; identical to SEQ ID NO: 94361
  derived and/or modified sequence opt2 from hemagglutinin__InfluenzaA__ACZ96679

SEQ ID NO: 95388 - RNA, 1701 nt, Artificial Sequence; identical to SEQ ID NO: 94361
  derived and/or modified sequence opt2 from hemagglutinin__InfluenzaA__ACZ96689

SEQ ID NO: 95389 - RNA, 1701 nt, Artificial Sequence; identical to SEQ ID NO: 94361
  derived and/or modified sequence opt2 from hemagglutinin__InfluenzaA__ACZ96699

SEQ ID NO: 95390 - RNA, 1701 nt, Artificial Sequence; identical to SEQ ID NO: 94361
  derived and/or modified sequence opt2 from hemagglutinin__InfluenzaA__ACZ96719

SEQ ID NO: 95391 - RNA, 1701 nt, Artificial Sequence; identical to SEQ ID NO: 94361
  derived and/or modified sequence opt2 from hemagglutinin__InfluenzaA__ACZ96729

SEQ ID NO: 95392 - RNA, 1701 nt, Artificial Sequence; identical to SEQ ID NO: 94361
  derived and/or modified sequence opt2 from hemagglutinin__InfluenzaA__ACZ96739

SEQ ID NO: 95393 - RNA, 1701 nt, Artificial Sequence
  derived and/or modified sequence opt2 from hemagglutinin__InfluenzaA__ACZ96749
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95394 - RNA, 1701 nt, Artificial Sequence; identical to SEQ ID NO: 94168
  derived and/or modified sequence opt2 from hemagglutinin__InfluenzaA__ACZ96759

SEQ ID NO: 95395 - RNA, 1701 nt, Artificial Sequence; identical to SEQ ID NO: 94168
  derived and/or modified sequence opt2 from hemagglutinin__InfluenzaA__ACZ96769

SEQ ID NO: 95396 - RNA, 1701 nt, Artificial Sequence; identical to SEQ ID NO: 94168
  derived and/or modified sequence opt2 from hemagglutinin__InfluenzaA__ACZ96779

SEQ ID NO: 95397 - RNA, 1701 nt, Artificial Sequence; identical to SEQ ID NO: 94168
  derived and/or modified sequence opt2 from hemagglutinin__InfluenzaA__ACZ96789

SEQ ID NO: 95398 - RNA, 1701 nt, Artificial Sequence
  derived and/or modified sequence opt2 from hemagglutinin__InfluenzaA__ACZ96809
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucgccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95399 - RNA, 1701 nt, Artificial Sequence; identical to SEQ ID NO: 94168
  derived and/or modified sequence opt2 from hemagglutinin__InfluenzaA__ACZ96819

SEQ ID NO: 95400 - RNA, 1701 nt, Artificial Sequence; identical to SEQ ID NO: 94168
  derived and/or modified sequence opt2 from hemagglutinin__InfluenzaA__ACZ96829

SEQ ID NO: 95401 - RNA, 1701 nt, Artificial Sequence; identical to SEQ ID NO: 94168
  derived and/or modified sequence opt2 from hemagglutinin__InfluenzaA__ACZ96839

SEQ ID NO: 95402 - RNA, 1701 nt, Artificial Sequence; identical to SEQ ID NO: 95321
  derived and/or modified sequence opt2 from hemagglutinin__InfluenzaA__ACZ96849

SEQ ID NO: 95403 - RNA, 1701 nt, Artificial Sequence; identical to SEQ ID NO: 94181
  derived and/or modified sequence opt2 from hemagglutinin__InfluenzaA__ACZ96859

SEQ ID NO: 95404 - RNA, 1701 nt, Artificial Sequence; identical to SEQ ID NO: 94168
  derived and/or modified sequence opt2 from hemagglutinin__InfluenzaA__ACZ96869

SEQ ID NO: 95405 - RNA, 1701 nt, Artificial Sequence; identical to SEQ ID NO: 94168
  derived and/or modified sequence opt2 from hemagglutinin__InfluenzaA__ACZ96879

SEQ ID NO: 95406 - RNA, 1701 nt, Artificial Sequence
  derived and/or modified sequence opt2 from hemagglutinin__InfluenzaA__ACZ96899
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacuccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95407 - RNA, 1701 nt, Artificial Sequence; identical to SEQ ID NO: 94168
  derived and/or modified sequence opt2 from hemagglutinin__InfluenzaA__ACZ96909

SEQ ID NO: 95408 - RNA, 1701 nt, Artificial Sequence; identical to SEQ ID NO: 94168
  derived and/or modified sequence opt2 from hemagglutinin__InfluenzaA__ACZ96919

SEQ ID NO: 95409 - RNA, 1701 nt, Artificial Sequence; identical to SEQ ID NO: 94168
  derived and/or modified sequence opt2 from hemagglutinin__InfluenzaA__ACZ96929

SEQ ID NO: 95410 - RNA, 1701 nt, Artificial Sequence; identical to SEQ ID NO: 94168
  derived and/or modified sequence opt2 from hemagglutinin__InfluenzaA__ACZ96939

SEQ ID NO: 95411 - RNA, 1701 nt, Artificial Sequence
  derived and/or modified sequence opt2 from hemagglutinin__InfluenzaA__ACZ96949
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagaugcucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95412 - RNA, 1701 nt, Artificial Sequence; identical to SEQ ID NO: 94168
  derived and/or modified sequence opt2 from hemagglutinin__InfluenzaA__ACZ97021

SEQ ID NO: 95413 - RNA, 1701 nt, Artificial Sequence; identical to SEQ ID NO: 94535
  derived and/or modified sequence opt2 from hemagglutinin__InfluenzaA__ACZ97343

SEQ ID NO: 95414 - RNA, 1701 nt, Artificial Sequence; identical to SEQ ID NO: 94535
  derived and/or modified sequence opt2 from hemagglutinin__InfluenzaA__ACZ97353

SEQ ID NO: 95415 - RNA, 1701 nt, Artificial Sequence; identical to SEQ ID NO: 94168
  derived and/or modified sequence opt2 from hemagglutinin__InfluenzaA__ACZ97363

SEQ ID NO: 95416 - RNA, 1701 nt, Artificial Sequence
  derived and/or modified sequence opt2 from hemagglutinin__InfluenzaA__ACZ97383
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95417 - RNA, 1701 nt, Artificial Sequence; identical to SEQ ID NO: 94168
  derived and/or modified sequence opt2 from hemagglutinin__InfluenzaA__ACZ97393

SEQ ID NO: 95418 - RNA, 1701 nt, Artificial Sequence
  derived and/or modified sequence opt2 from hemagglutinin__InfluenzaA__ACZ98178
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacuacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95419 - RNA, 1701 nt, Artificial Sequence; identical to SEQ ID NO: 94168
  derived and/or modified sequence opt2 from hemagglutinin__InfluenzaA__ACZ98188

SEQ ID NO: 95420 - RNA, 1701 nt, Artificial Sequence; identical to SEQ ID NO: 94361
  derived and/or modified sequence opt2 from hemagglutinin__InfluenzaA__ACZ98198

SEQ ID NO: 95421 - RNA, 1701 nt, Artificial Sequence; identical to SEQ ID NO: 94181
  derived and/or modified sequence opt2 from hemagglutinin__InfluenzaA__ACZ98208

SEQ ID NO: 95422 - RNA, 1701 nt, Artificial Sequence; identical to SEQ ID NO: 94181
  derived and/or modified sequence opt2 from hemagglutinin__InfluenzaA__ACZ98218

SEQ ID NO: 95423 - RNA, 1701 nt, Artificial Sequence; identical to SEQ ID NO: 94181
  derived and/or modified sequence opt2 from hemagglutinin__InfluenzaA__ACZ98228

SEQ ID NO: 95424 - RNA, 1701 nt, Artificial Sequence; identical to SEQ ID NO: 94181
  derived and/or modified sequence opt2 from hemagglutinin__InfluenzaA__ACZ98238

SEQ ID NO: 95425 - RNA, 1701 nt, Artificial Sequence; identical to SEQ ID NO: 94810
  derived and/or modified sequence opt2 from hemagglutinin__InfluenzaA__ACZ98248

SEQ ID NO: 95426 - RNA, 1701 nt, Artificial Sequence; identical to SEQ ID NO: 94181
  derived and/or modified sequence opt2 from hemagglutinin__InfluenzaA__ACZ98258

SEQ ID NO: 95427 - RNA, 1701 nt, Artificial Sequence; identical to SEQ ID NO: 94181
  derived and/or modified sequence opt2 from hemagglutinin__InfluenzaA__ACZ98268

SEQ ID NO: 95428 - RNA, 1701 nt, Artificial Sequence; identical to SEQ ID NO: 95321
  derived and/or modified sequence opt2 from hemagglutinin__InfluenzaA__ACZ98278

SEQ ID NO: 95429 - RNA, 1701 nt, Artificial Sequence; identical to SEQ ID NO: 95321
  derived and/or modified sequence opt2 from hemagglutinin__InfluenzaA__ACZ98288

SEQ ID NO: 95430 - RNA, 1701 nt, Artificial Sequence
  derived and/or modified sequence opt2 from hemagglutinin__InfluenzaA__ACZ98298
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95431 - RNA, 1701 nt, Artificial Sequence
  derived and/or modified sequence opt2 from hemagglutinin__InfluenzaA__ACZ98318
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccacauccucgccaucuacuccaccgucgccuccucccucguccucgucgucucccucggcgccaucuccuucuggaugugcuccaacggcucccuccagugccgcaucugcaucuga

SEQ ID NO: 95432 - RNA, 1701 nt, Artificial Sequence; identical to SEQ ID NO: 94423
  derived and/or modified sequence opt2 from hemagglutinin__InfluenzaA__ACZ98328

SEQ ID NO: 95433 - RNA, 1701 nt, Artificial Sequence; identical to SEQ ID NO: 94181
  derived and/or modified sequence opt2 from hemagglutinin__InfluenzaA__ACZ98338

SEQ ID NO: 95434 - RNA, 1701 nt, Artificial Sequence; identical to SEQ ID NO: 95321
  derived and/or modified sequence opt2 from hemagglutinin__InfluenzaA__ACZ98348

SEQ ID NO: 95435 - RNA, 1701 nt, Artificial Sequence; identical to SEQ ID NO: 94181
  derived and/or modified sequence opt2 from hemagglutinin__InfluenzaA__ACZ98358

SEQ ID NO: 95436 - RNA, 1701 nt, Artificial Sequence; identical to SEQ ID NO: 94181
  derived and/or modified sequence opt2 from hemagglutinin__InfluenzaA__ACZ98368

SEQ ID NO: 95437 - RNA, 1701 nt, Artificial Sequence; identical to SEQ ID NO: 94423
  derived and/or modified sequence opt2 from hemagglutinin__InfluenzaA__ACZ98388

SEQ ID NO: 95438 - RNA, 1701 nt, Artificial Sequence; identical to SEQ ID NO: 94181
  derived and/or modified sequence opt2 from hemagglutinin__InfluenzaA__ACZ98398

SEQ ID NO: 95439 - RNA, 1701 nt, Artificial Sequence; identical to SEQ ID NO: 94181
  derived and/or modified sequence opt2 from hemagglutinin__InfluenzaA__ACZ98408

SEQ ID NO: 95440 - RNA, 1701 nt, Artificial Sequence; identical to SEQ ID NO: 94361
  derived and/or modified sequence opt2 from hemagglutinin__InfluenzaA__ACZ98418

SEQ ID NO: 95441 - RNA, 1701 nt, Artificial Sequence; identical to SEQ ID NO: 94181
  derived and/or modified sequence opt2 from hemagglutinin__InfluenzaA__ACZ98428

SEQ ID NO: 95442 - RNA, 1701 nt, Artificial Sequence; identical to SEQ ID NO: 94181
  derived and/or modified sequence opt2 from hemagglutinin__InfluenzaA__ACZ98438

SEQ ID NO: 95443 - RNA, 1701 nt, Artificial Sequence; identical to SEQ ID NO: 94181
  derived and/or modified sequence opt2 from hemagglutinin__InfluenzaA__ACZ98448

SEQ ID NO: 95444 - RNA, 1701 nt, Artificial Sequence; identical to SEQ ID NO: 95321
  derived and/or modified sequence opt2 from hemagglutinin__InfluenzaA__ACZ98458

SEQ ID NO: 95445 - RNA, 1701 nt, Artificial Sequence
  derived and/or modified sequence opt2 from hemagglutinin__InfluenzaA__ACZ98546
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucaccaccggccuccgcaacguccccuccauccaguaccgcggccucuucggcgccaucaccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95446 - RNA, 1701 nt, Artificial Sequence
  derived and/or modified sequence opt2 from hemagglutinin__InfluenzaA__ACZ98560
augaaggccauccgcgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaagucccccaagcuccgccucgccaccggcaugcgcaacguccccuucauccaguaccgcggccucuucggcgccaucaccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95447 - RNA, 1701 nt, Artificial Sequence
  derived and/or modified sequence opt2 from hemagglutinin__InfluenzaA__ACZ98567
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaagucccccaagcuccgccucgccuccggcaugcgcaacguccccuucauccagucccgcggccucuucggcgccaucaccggcuucaucgaggagggcuggaccggcauggucgacggcugguacggcuuccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95448 - RNA, 1701 nt, Artificial Sequence; identical to SEQ ID NO: 94168
  derived and/or modified sequence opt2 from hemagglutinin__InfluenzaA__ACZ98671

SEQ ID NO: 95449 - RNA, 1701 nt, Artificial Sequence; identical to SEQ ID NO: 94168
  derived and/or modified sequence opt2 from hemagglutinin__InfluenzaA__ACZ98681

SEQ ID NO: 95450 - RNA, 1701 nt, Artificial Sequence; identical to SEQ ID NO: 94181
  derived and/or modified sequence opt2 from hemagglutinin__InfluenzaA__ACZ98691

SEQ ID NO: 95451 - RNA, 1701 nt, Artificial Sequence
  derived and/or modified sequence opt2 from hemagglutinin__InfluenzaA__ADA60799
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95452 - RNA, 1701 nt, Artificial Sequence; identical to SEQ ID NO: 95345
  derived and/or modified sequence opt2 from hemagglutinin__InfluenzaA__ADA69302

SEQ ID NO: 95453 - RNA, 1701 nt, Artificial Sequence; identical to SEQ ID NO: 95345
  derived and/or modified sequence opt2 from hemagglutinin__InfluenzaA__ADA69312

SEQ ID NO: 95454 - RNA, 1701 nt, Artificial Sequence; identical to SEQ ID NO: 95345
  derived and/or modified sequence opt2 from hemagglutinin__InfluenzaA__ADA69322

SEQ ID NO: 95455 - RNA, 1701 nt, Artificial Sequence; identical to SEQ ID NO: 95345
  derived and/or modified sequence opt2 from hemagglutinin__InfluenzaA__ADA69332

SEQ ID NO: 95456 - RNA, 1701 nt, Artificial Sequence; identical to SEQ ID NO: 95282
  derived and/or modified sequence opt2 from hemagglutinin__InfluenzaA__ADA70329

SEQ ID NO: 95457 - RNA, 1698 nt, Artificial Sequence
  derived and/or modified sequence opt2 from hemagglutinin__InfluenzaA__ADA71150
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccucgucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaagaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95458 - RNA, 1701 nt, Artificial Sequence
  derived and/or modified sequence opt2 from hemagglutinin__InfluenzaA__ADA71152
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcggcaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95459 - RNA, 1698 nt, Artificial Sequence
  derived and/or modified sequence opt2 from hemagglutinin__InfluenzaA__ADA71154
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaacuccgagugcgagcuccucaucuccaaggaguccugguccuacaucgucgagaagcccaaccccgagaacggcaccugcuacuucggccacuucgccgacuacgaggagcuccgcgagcaguucggcuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95460 - RNA, 1698 nt, Artificial Sequence
  derived and/or modified sequence opt2 from hemagglutinin__InfluenzaA__ADA71158
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggagaccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagcgcacccucuaccacaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagucccucauggacauccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95461 - RNA, 1701 nt, Artificial Sequence; identical to SEQ ID NO: 93946
  derived and/or modified sequence opt2 from hemagglutinin__InfluenzaA__ADA71162

SEQ ID NO: 95462 - RNA, 1698 nt, Artificial Sequence
  derived and/or modified sequence opt2 from hemagglutinin__InfluenzaA__ADA71164
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucgucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccuccaucgccgaccagaagacccucuaccacaccgagaacgccuacgucuccgucgucuccucccacuacucccgcaaguucacccccgagaucgccaagcgccccaagguccgcgaccaggagggccgcauccacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaccugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaucucccagcucaagaucaacgccaaggaccucggcuacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95463 - RNA, 1698 nt, Artificial Sequence
  derived and/or modified sequence opt2 from hemagglutinin__InfluenzaA__ADA71168
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaaggccccccuccagcucggcaacugcuccgucgccggcuggauccucggcaaccccgagugcggccuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcguccagaugacccucuaccacaaggagaacgccuacgucuccgucgucuccucccacuacucccgcaaguucacccccgagaucgucaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95464 - RNA, 1698 nt, Artificial Sequence
  derived and/or modified sequence opt2 from hemagglutinin__InfluenzaA__ADA71170
augaaggucaagcuccucguccuccucugcaccuucaccgccaccuacgccgacaccaucugcaucggcuaccacgccaacaacuccaccgacaccgucgacaccguccucgagaagaacggcaccgucacccccuccggcaaccucgucgagaacucccccaacggcaagcucugccuccucaagggcaucaccccccuccagcucggcaagugcuccgucgccggcuggauccucggcaaccccaagugggagcuccucgucuccaaggaguccugguccuacaucggcaagaagcccaaccccgagaacggcaccugcuaccccggccacuuccccuacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95465 - RNA, 1701 nt, Artificial Sequence
  derived and/or modified sequence opt2 from hemagglutinin__InfluenzaA__ADA71172
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95466 - RNA, 1698 nt, Artificial Sequence
  derived and/or modified sequence opt2 from hemagglutinin__InfluenzaA__ADA71176
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaccugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95467 - RNA, 1701 nt, Artificial Sequence; identical to SEQ ID NO: 95282
  derived and/or modified sequence opt2 from hemagglutinin__InfluenzaA__ADA71181

SEQ ID NO: 95468 - RNA, 1701 nt, Artificial Sequence; identical to SEQ ID NO: 95282
  derived and/or modified sequence opt2 from hemagglutinin__InfluenzaA__ADA71191

SEQ ID NO: 95469 - RNA, 1701 nt, Artificial Sequence
  derived and/or modified sequence opt2 from hemagglutinin__InfluenzaA__ADA79587
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95470 - RNA, 1701 nt, Artificial Sequence
  derived and/or modified sequence opt2 from hemagglutinin__InfluenzaA__ADA79607
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95471 - RNA, 1701 nt, Artificial Sequence
  derived and/or modified sequence opt2 from hemagglutinin__InfluenzaA__ADA83043
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95472 - RNA, 1701 nt, Artificial Sequence
  derived and/or modified sequence opt2 from hemagglutinin__InfluenzaA__ADA83044
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccaacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccgacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95473 - RNA, 1701 nt, Artificial Sequence; identical to SEQ ID NO: 94181
  derived and/or modified sequence opt2 from hemagglutinin__InfluenzaA__ADA83580

SEQ ID NO: 95474 - RNA, 1701 nt, Artificial Sequence; identical to SEQ ID NO: 94181
  derived and/or modified sequence opt2 from hemagglutinin__InfluenzaA__ADA83587

SEQ ID NO: 95475 - RNA, 1701 nt, Artificial Sequence
  derived and/or modified sequence opt2 from hemagglutinin__InfluenzaA__ADA83591
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucuccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95476 - RNA, 1701 nt, Artificial Sequence; identical to SEQ ID NO: 94926
  derived and/or modified sequence opt2 from hemagglutinin__InfluenzaA__ADA83595

SEQ ID NO: 95477 - RNA, 1701 nt, Artificial Sequence; identical to SEQ ID NO: 94181
  derived and/or modified sequence opt2 from hemagglutinin__InfluenzaA__ADA83599

SEQ ID NO: 95478 - RNA, 1701 nt, Artificial Sequence; identical to SEQ ID NO: 94181
  derived and/or modified sequence opt2 from hemagglutinin__InfluenzaA__ADA83603

SEQ ID NO: 95479 - RNA, 1701 nt, Artificial Sequence; identical to SEQ ID NO: 94181
  derived and/or modified sequence opt2 from hemagglutinin__InfluenzaA__ADA83611

SEQ ID NO: 95480 - RNA, 1701 nt, Artificial Sequence
  derived and/or modified sequence opt2 from hemagglutinin__InfluenzaA__ADA83615
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgaccucaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95481 - RNA, 1701 nt, Artificial Sequence
  derived and/or modified sequence opt2 from hemagglutinin__InfluenzaA__ADA83622
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagcgccucuaccagaacgccgacgccuacgucuucgucggcaccucccgcuacuccaagaagcucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95482 - RNA, 1701 nt, Artificial Sequence; identical to SEQ ID NO: 94181
  derived and/or modified sequence opt2 from hemagglutinin__InfluenzaA__ADA83633

SEQ ID NO: 95483 - RNA, 1701 nt, Artificial Sequence; identical to SEQ ID NO: 94181
  derived and/or modified sequence opt2 from hemagglutinin__InfluenzaA__ADA83637

SEQ ID NO: 95484 - RNA, 1701 nt, Artificial Sequence; identical to SEQ ID NO: 94181
  derived and/or modified sequence opt2 from hemagglutinin__InfluenzaA__ADA83641

SEQ ID NO: 95485 - RNA, 1701 nt, Artificial Sequence; identical to SEQ ID NO: 94181
  derived and/or modified sequence opt2 from hemagglutinin__InfluenzaA__ADA83645

SEQ ID NO: 95486 - RNA, 1701 nt, Artificial Sequence; identical to SEQ ID NO: 94181
  derived and/or modified sequence opt2 from hemagglutinin__InfluenzaA__ADA83648

SEQ ID NO: 95487 - RNA, 1701 nt, Artificial Sequence; identical to SEQ ID NO: 94181
  derived and/or modified sequence opt2 from hemagglutinin__InfluenzaA__ADA83656

SEQ ID NO: 95488 - RNA, 1701 nt, Artificial Sequence; identical to SEQ ID NO: 94181
  derived and/or modified sequence opt2 from hemagglutinin__InfluenzaA__ADA83660

SEQ ID NO: 95489 - RNA, 1701 nt, Artificial Sequence
  derived and/or modified sequence opt2 from hemagglutinin__InfluenzaA__ADA83664
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaccgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95490 - RNA, 1701 nt, Artificial Sequence
  derived and/or modified sequence opt2 from hemagglutinin__InfluenzaA__ADA83668
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcggcucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95491 - RNA, 1701 nt, Artificial Sequence; identical to SEQ ID NO: 94181
  derived and/or modified sequence opt2 from hemagglutinin__InfluenzaA__ADA83672

SEQ ID NO: 95492 - RNA, 1701 nt, Artificial Sequence; identical to SEQ ID NO: 94181
  derived and/or modified sequence opt2 from hemagglutinin__InfluenzaA__ADA83676

SEQ ID NO: 95493 - RNA, 1701 nt, Artificial Sequence; identical to SEQ ID NO: 94181
  derived and/or modified sequence opt2 from hemagglutinin__InfluenzaA__ADA83680

SEQ ID NO: 95494 - RNA, 1701 nt, Artificial Sequence
  derived and/or modified sequence opt2 from hemagglutinin__InfluenzaA__ADA86068
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaucaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95495 - RNA, 1701 nt, Artificial Sequence
  derived and/or modified sequence opt2 from hemagglutinin__InfluenzaA__ADA86086
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95496 - RNA, 1701 nt, Artificial Sequence
  derived and/or modified sequence opt2 from hemagglutinin__InfluenzaA__ADA86087
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuucuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgcccucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95497 - RNA, 1701 nt, Artificial Sequence; identical to SEQ ID NO: 94979
  derived and/or modified sequence opt2 from hemagglutinin__InfluenzaA__ADA86088

SEQ ID NO: 95498 - RNA, 1701 nt, Artificial Sequence
  derived and/or modified sequence opt2 from hemagglutinin__InfluenzaA__ADB03603
augaaggccauccucaucguccuccucuacaccuucgccaccgcccacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcauggacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95499 - RNA, 1701 nt, Artificial Sequence; identical to SEQ ID NO: 94168
  derived and/or modified sequence opt2 from hemagglutinin__InfluenzaA__ADB03604

SEQ ID NO: 95500 - RNA, 1701 nt, Artificial Sequence
  derived and/or modified sequence opt2 from hemagglutinin__InfluenzaA__ADB03605
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcauggacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95501 - RNA, 1701 nt, Artificial Sequence; identical to SEQ ID NO: 94181
  derived and/or modified sequence opt2 from hemagglutinin__InfluenzaA__ADB03607

SEQ ID NO: 95502 - RNA, 1701 nt, Artificial Sequence; identical to SEQ ID NO: 94534
  derived and/or modified sequence opt2 from hemagglutinin__InfluenzaA__ADB03609

SEQ ID NO: 95503 - RNA, 1701 nt, Artificial Sequence; identical to SEQ ID NO: 94181
  derived and/or modified sequence opt2 from hemagglutinin__InfluenzaA__ADB03611

SEQ ID NO: 95504 - RNA, 1701 nt, Artificial Sequence
  derived and/or modified sequence opt2 from hemagglutinin__InfluenzaA__ADB03612
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuucauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95505 - RNA, 1701 nt, Artificial Sequence; identical to SEQ ID NO: 94181
  derived and/or modified sequence opt2 from hemagglutinin__InfluenzaA__ADB03614

SEQ ID NO: 95506 - RNA, 1701 nt, Artificial Sequence
  derived and/or modified sequence opt2 from hemagglutinin__InfluenzaA__ADB03617
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95507 - RNA, 1701 nt, Artificial Sequence; identical to SEQ ID NO: 94534
  derived and/or modified sequence opt2 from hemagglutinin__InfluenzaA__ADB03619

SEQ ID NO: 95508 - RNA, 1701 nt, Artificial Sequence
  derived and/or modified sequence opt2 from hemagglutinin__InfluenzaA__ADB03620
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucguccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95509 - RNA, 1701 nt, Artificial Sequence
  derived and/or modified sequence opt2 from hemagglutinin__InfluenzaA__ADB03622
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95510 - RNA, 1701 nt, Artificial Sequence; identical to SEQ ID NO: 95509
  derived and/or modified sequence opt2 from hemagglutinin__InfluenzaA__ADB03623

SEQ ID NO: 95511 - RNA, 1701 nt, Artificial Sequence
  derived and/or modified sequence opt2 from hemagglutinin__InfluenzaA__ADB03628
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95512 - RNA, 1701 nt, Artificial Sequence
  derived and/or modified sequence opt2 from hemagglutinin__InfluenzaA__ADB03629
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuuccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95513 - RNA, 1701 nt, Artificial Sequence
  derived and/or modified sequence opt2 from hemagglutinin__InfluenzaA__ADB03630
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95514 - RNA, 1701 nt, Artificial Sequence; identical to SEQ ID NO: 94926
  derived and/or modified sequence opt2 from hemagglutinin__InfluenzaA__ADB25319

SEQ ID NO: 95515 - RNA, 1701 nt, Artificial Sequence; identical to SEQ ID NO: 94181
  derived and/or modified sequence opt2 from hemagglutinin__InfluenzaA__ADB25321

SEQ ID NO: 95516 - RNA, 1701 nt, Artificial Sequence
  derived and/or modified sequence opt2 from hemagglutinin__InfluenzaA__ADB27970
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95517 - RNA, 1701 nt, Artificial Sequence; identical to SEQ ID NO: 94181
  derived and/or modified sequence opt2 from hemagglutinin__InfluenzaA__ADB27980

SEQ ID NO: 95518 - RNA, 1701 nt, Artificial Sequence; identical to SEQ ID NO: 94181
  derived and/or modified sequence opt2 from hemagglutinin__InfluenzaA__ADB54352

SEQ ID NO: 95519 - RNA, 1701 nt, Artificial Sequence; identical to SEQ ID NO: 94181
  derived and/or modified sequence opt2 from hemagglutinin__InfluenzaA__ADB54355

SEQ ID NO: 95520 - RNA, 1698 nt, Artificial Sequence
  derived and/or modified sequence opt2 from hemagglutinin__InfluenzaA__ADB65926
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaagcacaacggcaagcucugccuccucaagggcaaggccccccuccagcucggcaacugcuccgucgccggcuggauccucggcaaccccgagugcggccuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaugggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucggcuucuggaugugcuccaacggcucccuccagugccgcaucugcaucuga

SEQ ID NO: 95521 - RNA, 1698 nt, Artificial Sequence
  derived and/or modified sequence opt2 from hemagglutinin__InfluenzaA__ADB80153
augaaggucaagcuccucgcccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuucgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95522 - RNA, 1701 nt, Artificial Sequence; identical to SEQ ID NO: 95282
  derived and/or modified sequence opt2 from hemagglutinin__InfluenzaA__ADB81399

SEQ ID NO: 95523 - RNA, 1701 nt, Artificial Sequence; identical to SEQ ID NO: 95282
  derived and/or modified sequence opt2 from hemagglutinin__InfluenzaA__ADB81409

SEQ ID NO: 95524 - RNA, 1701 nt, Artificial Sequence
  derived and/or modified sequence opt2 from hemagglutinin__InfluenzaA__ADB81419
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccgaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95525 - RNA, 1701 nt, Artificial Sequence; identical to SEQ ID NO: 95341
  derived and/or modified sequence opt2 from hemagglutinin__InfluenzaA__ADB81429

SEQ ID NO: 95526 - RNA, 1701 nt, Artificial Sequence
  derived and/or modified sequence opt2 from hemagglutinin__InfluenzaA__ADB81439
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95527 - RNA, 1701 nt, Artificial Sequence
  derived and/or modified sequence opt2 from hemagglutinin__InfluenzaA__ADB81449
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95528 - RNA, 1701 nt, Artificial Sequence
  derived and/or modified sequence opt2 from hemagglutinin__InfluenzaA__ADB81459
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacggcggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95529 - RNA, 1701 nt, Artificial Sequence
  derived and/or modified sequence opt2 from hemagglutinin__InfluenzaA__ADB82655
augaaggccauccuccucguccuccucugcacccucgccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaaccuccgcggcaaggccccccuccaccucggcaagugcaacaucgccggcuggcuccucggcaaccccgagugcgagcuccucuucgccgucaacuccugguccuacaucgucgagaccuccaacuccgacaacggcaccugcuaccccggcgacuucaccuccuacgaggagcuccgcgagcagcucuccuccgucuccuccuucgagcgcuucgagaucuuccccaaggccuccuccuggcccaaccacgagaccaaccgcggcgucaccgccgccugccccuacgccggcaccaacggcuucuaccgcaaccucaucuggcucgucaagaaggagaacuccuaccccaagcuccgcaaguccuacgucaacaacaagaagaaggagguccucguccucuggggcauccaccacccccccaccaacaccgaccagcagucccucuaccagaacgccgacgccuacgucuucgucggcuccuccaaguacucccgcaaguucaagcccgagaucgccgagcgccccaagguccgcggccaggccggccgcaugaacuacuacuggacccucaucgagcccggcgacaccaucaccuucgaggccaccggcaaccucgucgccccccgcuacgccuucgccaugaaccgcggccccgucuccggcaucaucaccuccgacgcccccguccacgacugcaacgccaccugccagacccccaagggcgccaucaacaccucccuccccuuccagaacauccaccccaucaccaucggcgagugccccaaguacgucaaguccacccgccuccgcauggccaccggccuccgcaacauccccuccauccagucccgcggccucuucggcgccaucgccggcuucaucgagggcggcuggaccggcaugaucgacggcugguacggcuaccaccaccagaacggccagggcuccggcuacgccgccgaccagaaguccacccagaacgccaucgaccgcaucaccaacaaggucaacuccgucaucgagaagaugaacauccaguucaccgccgucggcaaggaguucaaccaccucgagcgccgcaucgagaaccucaacaagaaggucgacgacggcuuccucgacgucuggaccuacaacgccgagcuccucguccuccucgagaacgagcgcacccucgacuuccacgacuccaacgucaagacccucuacgagaaggucaagacccagcuccgcaacaacgccaaggagaucggcaacggcugcuucgaguucuaccacaagugcgacgacaccugcauggaguccaucaagaacggcaccuacaacuaccccaaguacuccgaggaguccaagcucaaccgcgaggagaucgacggcgucaagcucgaguccacccgcaucuaccagauccucgccaucuacuccaccgccgccuccucccucguccuccucgucucccucggcgccaucggcuucuggaugugcuccaacggcucccuccagugccgcaucugcaucuga

SEQ ID NO: 95530 - RNA, 1701 nt, Artificial Sequence
  derived and/or modified sequence opt2 from hemagglutinin__InfluenzaA__ADB82656
augaaggccauccuccucguccuccagugcauccucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucaagggcaucgccccccuccaccucggcaagugcaacaucgccggcuggcuccucggcaaccccgagugcgagcuccucuucaaggccaacuccugguccuacaucgucgagaccuccuacuccgacaacggcaccugcuaccccggcgacuucaccaacuacgaggagcuccgcgagcagcucuccuccgucuccuccuucgagcgcuucgagauguuccccaaggccaacuccuggcccaaccacgagaccaacaagggcgucaccgccgccugccccuacgccggcgccaacuccuucuaccgcaaccucaucuggcucgucaagaagggcaacuccuacccccgccucuccaaguccuacgucaacaacaagaagaaggagguccucguccucuggggcauccaccaccccuccaccuccaccgaccagcagucccucuaccagaacgccgacgccuacgucuucgucuccuccuccaccuacaacaagcgcuucaagcccgagaucggcacccgccccaagguccgcgaccaguccggccgcaugaacuacuacuggaccaucgucgagcccggcgacaccaucaccuucgaggccaccggcaaccucgucgccccccgcuacgccuucgccaugaagcgcgacuccggcuccggcaucaucauguccgacacccccguccacgacugcaacaccaccugccagacccccaagggcgccaucaacaccucccuccccuuccagaacguccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccaucaucgagaagaugaacauccaguucaccgccgucggcaaggaguucucccaccucgagaagcgcgucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacuccugcauggaguccaucaagaacgagaccuacgacuacuccaaguacuccgaggagucccgccucaaccgcgagaagaucgacggcgucaagcucgaguccacccagaucuaccagauccucgccaucuacuccaccgucgccuccucccucguccuccucgucucccucggcgccaucuccuucuggaugugcuccaacggcucccuccagugccgcaucugcaucuga

SEQ ID NO: 95531 - RNA, 1701 nt, Artificial Sequence
  derived and/or modified sequence opt2 from hemagglutinin__InfluenzaA__ADB82944
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95532 - RNA, 1701 nt, Artificial Sequence
  derived and/or modified sequence opt2 from hemagglutinin__InfluenzaA__ADB82950
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucgagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95533 - RNA, 1701 nt, Artificial Sequence; identical to SEQ ID NO: 94979
  derived and/or modified sequence opt2 from hemagglutinin__InfluenzaA__ADB89129

SEQ ID NO: 95534 - RNA, 1701 nt, Artificial Sequence; identical to SEQ ID NO: 94181
  derived and/or modified sequence opt2 from hemagglutinin__InfluenzaA__ADB89139

SEQ ID NO: 95535 - RNA, 1701 nt, Artificial Sequence
  derived and/or modified sequence opt2 from hemagglutinin__InfluenzaA__ADB89149
augaaggccauccucgucguccuccucuacaccuucgccaccgccaacgccuacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgucggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95536 - RNA, 1701 nt, Artificial Sequence; identical to SEQ ID NO: 94534
  derived and/or modified sequence opt2 from hemagglutinin__InfluenzaA__ADB89150

SEQ ID NO: 95537 - RNA, 1701 nt, Artificial Sequence
  derived and/or modified sequence opt2 from hemagglutinin__InfluenzaA__ADB89221
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagaaccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95538 - RNA, 1701 nt, Artificial Sequence; identical to SEQ ID NO: 94234
  derived and/or modified sequence opt2 from hemagglutinin__InfluenzaA__ADB89241

SEQ ID NO: 95539 - RNA, 1701 nt, Artificial Sequence; identical to SEQ ID NO: 94181
  derived and/or modified sequence opt2 from hemagglutinin__InfluenzaA__ADB89251

SEQ ID NO: 95540 - RNA, 1701 nt, Artificial Sequence; identical to SEQ ID NO: 94628
  derived and/or modified sequence opt2 from hemagglutinin__InfluenzaA__ADB89261

SEQ ID NO: 95541 - RNA, 1701 nt, Artificial Sequence
  derived and/or modified sequence opt2 from hemagglutinin__InfluenzaA__ADB89271
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcaugggcuccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95542 - RNA, 1701 nt, Artificial Sequence
  derived and/or modified sequence opt2 from hemagglutinin__InfluenzaA__ADB89281
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95543 - RNA, 1701 nt, Artificial Sequence; identical to SEQ ID NO: 94181
  derived and/or modified sequence opt2 from hemagglutinin__InfluenzaA__ADB89291

SEQ ID NO: 95544 - RNA, 1701 nt, Artificial Sequence; identical to SEQ ID NO: 94181
  derived and/or modified sequence opt2 from hemagglutinin__InfluenzaA__ADB89301

SEQ ID NO: 95545 - RNA, 1701 nt, Artificial Sequence; identical to SEQ ID NO: 94181
  derived and/or modified sequence opt2 from hemagglutinin__InfluenzaA__ADB89311

SEQ ID NO: 95546 - RNA, 1701 nt, Artificial Sequence
  derived and/or modified sequence opt2 from hemagglutinin__InfluenzaA__ADB89321
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95547 - RNA, 1701 nt, Artificial Sequence
  derived and/or modified sequence opt2 from hemagglutinin__InfluenzaA__ADB89331
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 95548 - RNA, 1701 nt, Artificial Sequence; identical to SEQ ID NO: 94181
  derived and/or modified sequence opt2 from hemagglutinin__InfluenzaA__ADB89341

SEQ ID NO: 95549 - RNA, 1701 nt, Artificial Sequence; identical to SEQ ID NO: 94181
  derived and/or modified sequence opt2 from hemagglutinin__InfluenzaA__ADB89351

SEQ ID NO: 95550 - RNA, 1701 nt, Artificial Sequence; identical to SEQ ID NO: 94181
  derived and/or modified sequence opt2 from hemagglutinin__InfluenzaA__ADB89361

SEQ ID NO: 95551 - RNA, 1701 nt, Artificial Sequence; identical to SEQ ID NO: 94181
  derived and/or modified sequence opt2 from hemagglutinin__InfluenzaA__ADB89371

SEQ ID NO: 95552 - RNA, 1701 nt, Artificial Sequence; identical to SEQ ID NO: 94926
  derived and/or modified sequence opt2 from hemagglutinin__InfluenzaA__ADB89381

SEQ ID NO: 95553 - RNA, 1701 nt, Artificial Sequence
  derived and/or modified sequence opt2 from hemagglutinin__InfluenzaA__ADB89391
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95554 - RNA, 1701 nt, Artificial Sequence; identical to SEQ ID NO: 94168
  derived and/or modified sequence opt2 from hemagglutinin__InfluenzaA__ADB89401

SEQ ID NO: 95555 - RNA, 1701 nt, Artificial Sequence; identical to SEQ ID NO: 94181
  derived and/or modified sequence opt2 from hemagglutinin__InfluenzaA__ADB89411

SEQ ID NO: 95556 - RNA, 1701 nt, Artificial Sequence; identical to SEQ ID NO: 94628
  derived and/or modified sequence opt2 from hemagglutinin__InfluenzaA__ADB89431

SEQ ID NO: 95557 - RNA, 1701 nt, Artificial Sequence; identical to SEQ ID NO: 94534
  derived and/or modified sequence opt2 from hemagglutinin__InfluenzaA__ADB89441

SEQ ID NO: 95558 - RNA, 1701 nt, Artificial Sequence; identical to SEQ ID NO: 94181
  derived and/or modified sequence opt2 from hemagglutinin__InfluenzaA__ADB89461

SEQ ID NO: 95559 - RNA, 1701 nt, Artificial Sequence; identical to SEQ ID NO: 94628
  derived and/or modified sequence opt2 from hemagglutinin__InfluenzaA__ADB89481

SEQ ID NO: 95560 - RNA, 1701 nt, Artificial Sequence; identical to SEQ ID NO: 94628
  derived and/or modified sequence opt2 from hemagglutinin__InfluenzaA__ADB89491

SEQ ID NO: 95561 - RNA, 1701 nt, Artificial Sequence
  derived and/or modified sequence opt2 from hemagglutinin__InfluenzaA__ADB89501
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggccucgucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95562 - RNA, 1701 nt, Artificial Sequence; identical to SEQ ID NO: 94181
  derived and/or modified sequence opt2 from hemagglutinin__InfluenzaA__ADB89511

SEQ ID NO: 95563 - RNA, 1701 nt, Artificial Sequence; identical to SEQ ID NO: 94628
  derived and/or modified sequence opt2 from hemagglutinin__InfluenzaA__ADB89531

SEQ ID NO: 95564 - RNA, 1701 nt, Artificial Sequence; identical to SEQ ID NO: 94628
  derived and/or modified sequence opt2 from hemagglutinin__InfluenzaA__ADB89541

SEQ ID NO: 95565 - RNA, 1701 nt, Artificial Sequence; identical to SEQ ID NO: 95341
  derived and/or modified sequence opt2 from hemagglutinin__InfluenzaA__ADB89551

SEQ ID NO: 95566 - RNA, 1701 nt, Artificial Sequence; identical to SEQ ID NO: 94181
  derived and/or modified sequence opt2 from hemagglutinin__InfluenzaA__ADB89561

SEQ ID NO: 95567 - RNA, 1701 nt, Artificial Sequence; identical to SEQ ID NO: 94181
  derived and/or modified sequence opt2 from hemagglutinin__InfluenzaA__ADB89571

SEQ ID NO: 95568 - RNA, 1701 nt, Artificial Sequence; identical to SEQ ID NO: 94181
  derived and/or modified sequence opt2 from hemagglutinin__InfluenzaA__ADB89581

SEQ ID NO: 95569 - RNA, 1701 nt, Artificial Sequence
  derived and/or modified sequence opt2 from hemagglutinin__InfluenzaA__ADB89591
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacugggcccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95570 - RNA, 1701 nt, Artificial Sequence
  derived and/or modified sequence opt2 from hemagglutinin__InfluenzaA__ADB89601
augaaggccaucaucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucaccaucuacuccaccgucgccuccucccucguccucgucgucucccucggcgccaucuccuucuggaugugcuccaacggcucccuccagugccgcaucugcaucuga

SEQ ID NO: 95571 - RNA, 1701 nt, Artificial Sequence; identical to SEQ ID NO: 95345
  derived and/or modified sequence opt2 from hemagglutinin__InfluenzaA__ADB89611

SEQ ID NO: 95572 - RNA, 1701 nt, Artificial Sequence; identical to SEQ ID NO: 95345
  derived and/or modified sequence opt2 from hemagglutinin__InfluenzaA__ADB89621

SEQ ID NO: 95573 - RNA, 1701 nt, Artificial Sequence
  derived and/or modified sequence opt2 from hemagglutinin__InfluenzaA__ADB89631
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95574 - RNA, 1701 nt, Artificial Sequence; identical to SEQ ID NO: 95345
  derived and/or modified sequence opt2 from hemagglutinin__InfluenzaA__ADB89641

SEQ ID NO: 95575 - RNA, 1701 nt, Artificial Sequence; identical to SEQ ID NO: 94181
  derived and/or modified sequence opt2 from hemagglutinin__InfluenzaA__ADB89651

SEQ ID NO: 95576 - RNA, 1701 nt, Artificial Sequence; identical to SEQ ID NO: 94181
  derived and/or modified sequence opt2 from hemagglutinin__InfluenzaA__ADB89661

SEQ ID NO: 95577 - RNA, 1701 nt, Artificial Sequence; identical to SEQ ID NO: 95345
  derived and/or modified sequence opt2 from hemagglutinin__InfluenzaA__ADB89671

SEQ ID NO: 95578 - RNA, 1701 nt, Artificial Sequence; identical to SEQ ID NO: 94181
  derived and/or modified sequence opt2 from hemagglutinin__InfluenzaA__ADB89681

SEQ ID NO: 95579 - RNA, 1701 nt, Artificial Sequence; identical to SEQ ID NO: 94181
  derived and/or modified sequence opt2 from hemagglutinin__InfluenzaA__ADB89691

SEQ ID NO: 95580 - RNA, 1701 nt, Artificial Sequence; identical to SEQ ID NO: 95283
  derived and/or modified sequence opt2 from hemagglutinin__InfluenzaA__ADB89701

SEQ ID NO: 95581 - RNA, 1701 nt, Artificial Sequence
  derived and/or modified sequence opt2 from hemagglutinin__InfluenzaA__ADB89711
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95582 - RNA, 1701 nt, Artificial Sequence
  derived and/or modified sequence opt2 from hemagglutinin__InfluenzaA__ADB89721
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucgacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuaccucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95583 - RNA, 1701 nt, Artificial Sequence
  derived and/or modified sequence opt2 from hemagglutinin__InfluenzaA__ADB90360
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccaacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95584 - RNA, 1701 nt, Artificial Sequence
  derived and/or modified sequence opt2 from hemagglutinin__InfluenzaA__ADB90370
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95585 - RNA, 1701 nt, Artificial Sequence; identical to SEQ ID NO: 95100
  derived and/or modified sequence opt2 from hemagglutinin__InfluenzaA__ADB90414

SEQ ID NO: 95586 - RNA, 1701 nt, Artificial Sequence; identical to SEQ ID NO: 94628
  derived and/or modified sequence opt2 from hemagglutinin__InfluenzaA__ADC32409

SEQ ID NO: 95587 - RNA, 1701 nt, Artificial Sequence
  derived and/or modified sequence opt2 from hemagglutinin__InfluenzaA__ADC32410
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagaagacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95588 - RNA, 1701 nt, Artificial Sequence
  derived and/or modified sequence opt2 from hemagglutinin__InfluenzaA__ADC32411
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgccaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95589 - RNA, 1701 nt, Artificial Sequence; identical to SEQ ID NO: 94534
  derived and/or modified sequence opt2 from hemagglutinin__InfluenzaA__ADC32412

SEQ ID NO: 95590 - RNA, 1701 nt, Artificial Sequence; identical to SEQ ID NO: 94181
  derived and/or modified sequence opt2 from hemagglutinin__InfluenzaA__ADC32413

SEQ ID NO: 95591 - RNA, 1701 nt, Artificial Sequence; identical to SEQ ID NO: 94628
  derived and/or modified sequence opt2 from hemagglutinin__InfluenzaA__ADC32414

SEQ ID NO: 95592 - RNA, 1701 nt, Artificial Sequence; identical to SEQ ID NO: 94628
  derived and/or modified sequence opt2 from hemagglutinin__InfluenzaA__ADC32415

SEQ ID NO: 95593 - RNA, 1701 nt, Artificial Sequence; identical to SEQ ID NO: 94628
  derived and/or modified sequence opt2 from hemagglutinin__InfluenzaA__ADC32416

SEQ ID NO: 95594 - RNA, 1701 nt, Artificial Sequence
  derived and/or modified sequence opt2 from hemagglutinin__InfluenzaA__ADC32417
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaguacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95595 - RNA, 1701 nt, Artificial Sequence; identical to SEQ ID NO: 94628
  derived and/or modified sequence opt2 from hemagglutinin__InfluenzaA__ADC32418

SEQ ID NO: 95596 - RNA, 1701 nt, Artificial Sequence
  derived and/or modified sequence opt2 from hemagglutinin__InfluenzaA__ADC32419
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguucggcuaccaccaccagaacgaccagggcuccgccuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95597 - RNA, 1701 nt, Artificial Sequence; identical to SEQ ID NO: 94628
  derived and/or modified sequence opt2 from hemagglutinin__InfluenzaA__ADC32420

SEQ ID NO: 95598 - RNA, 1701 nt, Artificial Sequence; identical to SEQ ID NO: 94628
  derived and/or modified sequence opt2 from hemagglutinin__InfluenzaA__ADC32421

SEQ ID NO: 95599 - RNA, 1701 nt, Artificial Sequence
  derived and/or modified sequence opt2 from hemagglutinin__InfluenzaA__ADC32422
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95600 - RNA, 1701 nt, Artificial Sequence
  derived and/or modified sequence opt2 from hemagglutinin__InfluenzaA__ADC32423
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucaacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95601 - RNA, 1701 nt, Artificial Sequence
  derived and/or modified sequence opt2 from hemagglutinin__InfluenzaA__ADC32434
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95602 - RNA, 1701 nt, Artificial Sequence; identical to SEQ ID NO: 95601
  derived and/or modified sequence opt2 from hemagglutinin__InfluenzaA__ADC32435

SEQ ID NO: 95603 - RNA, 1701 nt, Artificial Sequence
  derived and/or modified sequence opt2 from hemagglutinin__InfluenzaA__ADC34940
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagcgcuucaacuggaccggcgucacccagaacggcaccuccuccgccugcaagcgcggcuccgacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccuccacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 95604 - RNA, 1701 nt, Artificial Sequence; identical to SEQ ID NO: 95516
  derived and/or modified sequence opt2 from hemagglutinin__InfluenzaA__ADC38987

SEQ ID NO: 95605 - RNA, 1701 nt, Artificial Sequence
  derived and/or modified sequence opt2 from hemagglutinin__InfluenzaA__ADC38997
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggacguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95606 - RNA, 1701 nt, Artificial Sequence; identical to SEQ ID NO: 95282
  derived and/or modified sequence opt2 from hemagglutinin__InfluenzaA__ADC39007

SEQ ID NO: 95607 - RNA, 1698 nt, Artificial Sequence
  derived and/or modified sequence opt2 from hemagglutinin__InfluenzaA__ADC45604
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggccucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95608 - RNA, 1698 nt, Artificial Sequence
  derived and/or modified sequence opt2 from hemagglutinin__InfluenzaA__ADC45626
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95609 - RNA, 1698 nt, Artificial Sequence
  derived and/or modified sequence opt2 from hemagglutinin__InfluenzaA__ADC45637
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95610 - RNA, 1698 nt, Artificial Sequence
  derived and/or modified sequence opt2 from hemagglutinin__InfluenzaA__ADC45648
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccaucgccggcuggguccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95611 - RNA, 1698 nt, Artificial Sequence
  derived and/or modified sequence opt2 from hemagglutinin__InfluenzaA__ADC45659
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaagaaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95612 - RNA, 1698 nt, Artificial Sequence
  derived and/or modified sequence opt2 from hemagglutinin__InfluenzaA__ADC45670
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcggcuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95613 - RNA, 1698 nt, Artificial Sequence
  derived and/or modified sequence opt2 from hemagglutinin__InfluenzaA__ADC45681
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgccuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccuccgcaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95614 - RNA, 1698 nt, Artificial Sequence
  derived and/or modified sequence opt2 from hemagglutinin__InfluenzaA__ADC45692
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaagaaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95615 - RNA, 1698 nt, Artificial Sequence; identical to SEQ ID NO: 94682
  derived and/or modified sequence opt2 from hemagglutinin__InfluenzaA__ADC45703

SEQ ID NO: 95616 - RNA, 1698 nt, Artificial Sequence
  derived and/or modified sequence opt2 from hemagglutinin__InfluenzaA__ADC45714
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaccacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95617 - RNA, 1698 nt, Artificial Sequence; identical to SEQ ID NO: 94682
  derived and/or modified sequence opt2 from hemagglutinin__InfluenzaA__ADC45725

SEQ ID NO: 95618 - RNA, 1698 nt, Artificial Sequence
  derived and/or modified sequence opt2 from hemagglutinin__InfluenzaA__ADC45736
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacaccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95619 - RNA, 1698 nt, Artificial Sequence; identical to SEQ ID NO: 94000
  derived and/or modified sequence opt2 from hemagglutinin__InfluenzaA__ADC45747

SEQ ID NO: 95620 - RNA, 1698 nt, Artificial Sequence
  derived and/or modified sequence opt2 from hemagglutinin__InfluenzaA__ADC45758
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucaacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95621 - RNA, 1698 nt, Artificial Sequence; identical to SEQ ID NO: 95138
  derived and/or modified sequence opt2 from hemagglutinin__InfluenzaA__ADC45780

SEQ ID NO: 95622 - RNA, 1698 nt, Artificial Sequence; identical to SEQ ID NO: 94643
  derived and/or modified sequence opt2 from hemagglutinin__InfluenzaA__ADC45791

SEQ ID NO: 95623 - RNA, 1698 nt, Artificial Sequence
  derived and/or modified sequence opt2 from hemagglutinin__InfluenzaA__ADC45813
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccaugaagaacggccucuaccccaaccucuccaaguccuacgccaacaacaaggagaaggagguccucguccucuggggcguccaccacccccccaacaucggcgaccagaagacccucuacaacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95624 - RNA, 1698 nt, Artificial Sequence; identical to SEQ ID NO: 94643
  derived and/or modified sequence opt2 from hemagglutinin__InfluenzaA__ADC45824

SEQ ID NO: 95625 - RNA, 1698 nt, Artificial Sequence
  derived and/or modified sequence opt2 from hemagglutinin__InfluenzaA__ADC45835
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucacccucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95626 - RNA, 1698 nt, Artificial Sequence; identical to SEQ ID NO: 94000
  derived and/or modified sequence opt2 from hemagglutinin__InfluenzaA__ADC45846

SEQ ID NO: 95627 - RNA, 1701 nt, Artificial Sequence; identical to SEQ ID NO: 94181
  derived and/or modified sequence opt2 from hemagglutinin__InfluenzaA__ADC53558

SEQ ID NO: 95628 - RNA, 1701 nt, Artificial Sequence; identical to SEQ ID NO: 94272
  derived and/or modified sequence opt2 from hemagglutinin__InfluenzaA__ADD14087

SEQ ID NO: 95629 - RNA, 1701 nt, Artificial Sequence; identical to SEQ ID NO: 94181
  derived and/or modified sequence opt2 from hemagglutinin__InfluenzaA__ADD14089

SEQ ID NO: 95630 - RNA, 1701 nt, Artificial Sequence; identical to SEQ ID NO: 94181
  derived and/or modified sequence opt2 from hemagglutinin__InfluenzaA__ADD14093

SEQ ID NO: 95631 - RNA, 1701 nt, Artificial Sequence
  derived and/or modified sequence opt2 from hemagglutinin__InfluenzaA__ADD14095
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucguccucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95632 - RNA, 1701 nt, Artificial Sequence; identical to SEQ ID NO: 94181
  derived and/or modified sequence opt2 from hemagglutinin__InfluenzaA__ADD14097

SEQ ID NO: 95633 - RNA, 1701 nt, Artificial Sequence; identical to SEQ ID NO: 94181
  derived and/or modified sequence opt2 from hemagglutinin__InfluenzaA__ADD14099

SEQ ID NO: 95634 - RNA, 1701 nt, Artificial Sequence; identical to SEQ ID NO: 94181
  derived and/or modified sequence opt2 from hemagglutinin__InfluenzaA__ADD14101

SEQ ID NO: 95635 - RNA, 1701 nt, Artificial Sequence
  derived and/or modified sequence opt2 from hemagglutinin__InfluenzaA__ADD14103
augaaggccauccucgucguccuccucugcaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgacaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95636 - RNA, 1701 nt, Artificial Sequence
  derived and/or modified sequence opt2 from hemagglutinin__InfluenzaA__ADD14111
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaucuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95637 - RNA, 1701 nt, Artificial Sequence; identical to SEQ ID NO: 94181
  derived and/or modified sequence opt2 from hemagglutinin__InfluenzaA__ADD14115

SEQ ID NO: 95638 - RNA, 1701 nt, Artificial Sequence; identical to SEQ ID NO: 94181
  derived and/or modified sequence opt2 from hemagglutinin__InfluenzaA__ADD14117

SEQ ID NO: 95639 - RNA, 1701 nt, Artificial Sequence; identical to SEQ ID NO: 94181
  derived and/or modified sequence opt2 from hemagglutinin__InfluenzaA__ADD14119

SEQ ID NO: 95640 - RNA, 1701 nt, Artificial Sequence; identical to SEQ ID NO: 94181
  derived and/or modified sequence opt2 from hemagglutinin__InfluenzaA__ADD14121

SEQ ID NO: 95641 - RNA, 1701 nt, Artificial Sequence; identical to SEQ ID NO: 94181
  derived and/or modified sequence opt2 from hemagglutinin__InfluenzaA__ADD14123

SEQ ID NO: 95642 - RNA, 1701 nt, Artificial Sequence; identical to SEQ ID NO: 94181
  derived and/or modified sequence opt2 from hemagglutinin__InfluenzaA__ADD14127

SEQ ID NO: 95643 - RNA, 1701 nt, Artificial Sequence
  derived and/or modified sequence opt2 from hemagglutinin__InfluenzaA__ADD14129
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccucccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95644 - RNA, 1701 nt, Artificial Sequence
  derived and/or modified sequence opt2 from hemagglutinin__InfluenzaA__ADD14133
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgucgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuucggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95645 - RNA, 1701 nt, Artificial Sequence; identical to SEQ ID NO: 94272
  derived and/or modified sequence opt2 from hemagglutinin__InfluenzaA__ADD14135

SEQ ID NO: 95646 - RNA, 1701 nt, Artificial Sequence; identical to SEQ ID NO: 94181
  derived and/or modified sequence opt2 from hemagglutinin__InfluenzaA__ADD14137

SEQ ID NO: 95647 - RNA, 1701 nt, Artificial Sequence; identical to SEQ ID NO: 94929
  derived and/or modified sequence opt2 from hemagglutinin__InfluenzaA__ADD14139

SEQ ID NO: 95648 - RNA, 1701 nt, Artificial Sequence; identical to SEQ ID NO: 94181
  derived and/or modified sequence opt2 from hemagglutinin__InfluenzaA__ADD14143

SEQ ID NO: 95649 - RNA, 1701 nt, Artificial Sequence; identical to SEQ ID NO: 94181
  derived and/or modified sequence opt2 from hemagglutinin__InfluenzaA__ADD14145

SEQ ID NO: 95650 - RNA, 1701 nt, Artificial Sequence; identical to SEQ ID NO: 94181
  derived and/or modified sequence opt2 from hemagglutinin__InfluenzaA__ADD14147

SEQ ID NO: 95651 - RNA, 1701 nt, Artificial Sequence
  derived and/or modified sequence opt2 from hemagglutinin__InfluenzaA__ADD14151
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95652 - RNA, 1701 nt, Artificial Sequence; identical to SEQ ID NO: 94181
  derived and/or modified sequence opt2 from hemagglutinin__InfluenzaA__ADD14153

SEQ ID NO: 95653 - RNA, 1701 nt, Artificial Sequence; identical to SEQ ID NO: 94181
  derived and/or modified sequence opt2 from hemagglutinin__InfluenzaA__ADD14155

SEQ ID NO: 95654 - RNA, 1701 nt, Artificial Sequence; identical to SEQ ID NO: 94181
  derived and/or modified sequence opt2 from hemagglutinin__InfluenzaA__ADD14157

SEQ ID NO: 95655 - RNA, 1701 nt, Artificial Sequence; identical to SEQ ID NO: 94181
  derived and/or modified sequence opt2 from hemagglutinin__InfluenzaA__ADD14162

SEQ ID NO: 95656 - RNA, 1701 nt, Artificial Sequence; identical to SEQ ID NO: 94181
  derived and/or modified sequence opt2 from hemagglutinin__InfluenzaA__ADD14172

SEQ ID NO: 95657 - RNA, 1701 nt, Artificial Sequence; identical to SEQ ID NO: 94181
  derived and/or modified sequence opt2 from hemagglutinin__InfluenzaA__ADD14182

SEQ ID NO: 95658 - RNA, 1701 nt, Artificial Sequence; identical to SEQ ID NO: 94181
  derived and/or modified sequence opt2 from hemagglutinin__InfluenzaA__ADD14192

SEQ ID NO: 95659 - RNA, 1701 nt, Artificial Sequence; identical to SEQ ID NO: 94181
  derived and/or modified sequence opt2 from hemagglutinin__InfluenzaA__ADD14202

SEQ ID NO: 95660 - RNA, 1701 nt, Artificial Sequence
  derived and/or modified sequence opt2 from hemagglutinin__InfluenzaA__ADD21447
augaaggccauccucgucuuccuccucuacaccuucgccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagauguuccccaaguccuccuccuggcccaaccacgagaccaaccgcggcgucaccgccgccugccccuacgccggcgccaacuccuucuaccgcaaccucaucuggcucgucaagaaggagaacuccuaccccaagcucuccaaguccuacaucaacaacaaggagaaggagguccucguccucuggggcauccaccacccccccaccuccgccgaccagcagucccucuaccagaacgccgacgccuacgucuucgucggcuccuccaaguacaacaagaaguuccgccccgagaucgccgcccgccccaagguccgcggccagaccggccgcaugaacuacuacuggacccucgucgagcccggcgacaccaucaccuucgaggccaccgagaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaaccuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggccuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccguccgcaacggcgccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 95661 - RNA, 1701 nt, Artificial Sequence
  derived and/or modified sequence opt2 from hemagglutinin__InfluenzaA__ADD21457
augaaggccauccucgucuuccuccucuacaccuucgccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagauguuccccaaguccuccuccuggcccaaccacgagaccaaccgcggcgucaccgccgccugccccuacgccggcgccaacuccuucuaccgcaaccucaucuggcucgucaagaaggagaacuccuaccccaagcucuccaaguccuacaucaacaacaaggagaaggagguccucguccucuggggcauccaccacccccccaccuccgccgaccagcagucccucuaccagaacgccgacgccuacgucuucgucggcuccuccaaguacaacaagaaguuccgccccgagaucgccgcccgccccaagguccgcggccagaccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccgucaacaccucccuccccuuccagaacauccaccccgucaccaucggcgagugccccaaguacgucaaguccaccaaccuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggccuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccguccgcaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 95662 - RNA, 1698 nt, Artificial Sequence
  derived and/or modified sequence opt2 from hemagglutinin__InfluenzaA__ADD21467
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacauccgcgaccagcgcgcccucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacgcccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 95663 - RNA, 1701 nt, Artificial Sequence
  derived and/or modified sequence opt2 from hemagglutinin__InfluenzaA__ADD21560
augaagaccaucaucgccuucucccacauccucugccucaucuacgcccagaagcuccccggcuccgacaacuccauggccacccucugccucggccaccacgccguccccaacggcacccucgucaagaccaucaccgacgaccagaucgaggucaccaacgccaccgagcucguccaguccuccuccaccggccgcaucugcaacuccccccaccacauccucgacggcaagaacugcacccucaucgacgcccuccucggcgacccccacugcgacgacuuccagaacaaggagugggaccucuucgucgagcgcuccaccgccuacuccaacugcuaccccuacuacguccccgacuacgccucccuccgcucccucgucgccuccuccggcacccucgaguucacccaggaguccuucaacuggaccggcgucacccaggacggcuccuccuacaccugccgccgcaaguccgucaacuccuucuucucccgccucaacuggcuccacaaccucgacuacaaguaccccgcccucaacgucaccaugcccaacaacgacaaguucgacaagcucuacaucuggggcguccaccaccccggcaccgaccgcgaccagaccaaccucuacguccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccguccagcucaaguccggcuacaaggacuggauccucuggaucuccuucgccauguccugcuuccuccucugcgucguccuccucggcuucaucauguggaccugccagaagggcaacaucaagugcaacaucugcaucuga

SEQ ID NO: 95664 - RNA, 1701 nt, Artificial Sequence; identical to SEQ ID NO: 94168
  derived and/or modified sequence opt2 from hemagglutinin__InfluenzaA__ADD21734

SEQ ID NO: 95665 - RNA, 1701 nt, Artificial Sequence; identical to SEQ ID NO: 94181
  derived and/or modified sequence opt2 from hemagglutinin__InfluenzaA__ADD21744

SEQ ID NO: 95666 - RNA, 1701 nt, Artificial Sequence
  derived and/or modified sequence opt2 from hemagglutinin__InfluenzaA__ADD21764
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95667 - RNA, 1701 nt, Artificial Sequence
  derived and/or modified sequence opt2 from hemagglutinin__InfluenzaA__ADD21774
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccguccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95668 - RNA, 1701 nt, Artificial Sequence; identical to SEQ ID NO: 94181
  derived and/or modified sequence opt2 from hemagglutinin__InfluenzaA__ADD21784

SEQ ID NO: 95669 - RNA, 1701 nt, Artificial Sequence; identical to SEQ ID NO: 95341
  derived and/or modified sequence opt2 from hemagglutinin__InfluenzaA__ADD21794

SEQ ID NO: 95670 - RNA, 1701 nt, Artificial Sequence; identical to SEQ ID NO: 94181
  derived and/or modified sequence opt2 from hemagglutinin__InfluenzaA__ADD21804

SEQ ID NO: 95671 - RNA, 1701 nt, Artificial Sequence
  derived and/or modified sequence opt2 from hemagglutinin__InfluenzaA__ADD21814
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccuccuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95672 - RNA, 1701 nt, Artificial Sequence; identical to SEQ ID NO: 95341
  derived and/or modified sequence opt2 from hemagglutinin__InfluenzaA__ADD21824

SEQ ID NO: 95673 - RNA, 1701 nt, Artificial Sequence; identical to SEQ ID NO: 95341
  derived and/or modified sequence opt2 from hemagglutinin__InfluenzaA__ADD21834

SEQ ID NO: 95674 - RNA, 1701 nt, Artificial Sequence; identical to SEQ ID NO: 95345
  derived and/or modified sequence opt2 from hemagglutinin__InfluenzaA__ADD21844

SEQ ID NO: 95675 - RNA, 1701 nt, Artificial Sequence; identical to SEQ ID NO: 95345
  derived and/or modified sequence opt2 from hemagglutinin__InfluenzaA__ADD21854

SEQ ID NO: 95676 - RNA, 1701 nt, Artificial Sequence; identical to SEQ ID NO: 95283
  derived and/or modified sequence opt2 from hemagglutinin__InfluenzaA__ADD21864

SEQ ID NO: 95677 - RNA, 1701 nt, Artificial Sequence
  derived and/or modified sequence opt2 from hemagglutinin__InfluenzaA__ADD21884
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcaugggcuccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95678 - RNA, 1701 nt, Artificial Sequence; identical to SEQ ID NO: 95283
  derived and/or modified sequence opt2 from hemagglutinin__InfluenzaA__ADD21894

SEQ ID NO: 95679 - RNA, 1701 nt, Artificial Sequence
  derived and/or modified sequence opt2 from hemagglutinin__InfluenzaA__ADD22501
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcauccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95680 - RNA, 1701 nt, Artificial Sequence; identical to SEQ ID NO: 95283
  derived and/or modified sequence opt2 from hemagglutinin__InfluenzaA__ADD22511

SEQ ID NO: 95681 - RNA, 1701 nt, Artificial Sequence
  derived and/or modified sequence opt2 from hemagglutinin__InfluenzaA__ADD22521
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95682 - RNA, 1701 nt, Artificial Sequence; identical to SEQ ID NO: 94181
  derived and/or modified sequence opt2 from hemagglutinin__InfluenzaA__ADD22531

SEQ ID NO: 95683 - RNA, 1701 nt, Artificial Sequence
  derived and/or modified sequence opt2 from hemagglutinin__InfluenzaA__ADD22541
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95684 - RNA, 1701 nt, Artificial Sequence; identical to SEQ ID NO: 95283
  derived and/or modified sequence opt2 from hemagglutinin__InfluenzaA__ADD22554

SEQ ID NO: 95685 - RNA, 1701 nt, Artificial Sequence; identical to SEQ ID NO: 95283
  derived and/or modified sequence opt2 from hemagglutinin__InfluenzaA__ADD22564

SEQ ID NO: 95686 - RNA, 1701 nt, Artificial Sequence
  derived and/or modified sequence opt2 from hemagglutinin__InfluenzaA__ADD22574
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccucaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95687 - RNA, 1701 nt, Artificial Sequence; identical to SEQ ID NO: 95283
  derived and/or modified sequence opt2 from hemagglutinin__InfluenzaA__ADD22584

SEQ ID NO: 95688 - RNA, 1701 nt, Artificial Sequence; identical to SEQ ID NO: 94181
  derived and/or modified sequence opt2 from hemagglutinin__InfluenzaA__ADD22594

SEQ ID NO: 95689 - RNA, 1701 nt, Artificial Sequence; identical to SEQ ID NO: 95283
  derived and/or modified sequence opt2 from hemagglutinin__InfluenzaA__ADD22604

SEQ ID NO: 95690 - RNA, 1701 nt, Artificial Sequence; identical to SEQ ID NO: 95283
  derived and/or modified sequence opt2 from hemagglutinin__InfluenzaA__ADD22614

SEQ ID NO: 95691 - RNA, 1701 nt, Artificial Sequence; identical to SEQ ID NO: 95283
  derived and/or modified sequence opt2 from hemagglutinin__InfluenzaA__ADD22624

SEQ ID NO: 95692 - RNA, 1701 nt, Artificial Sequence
  derived and/or modified sequence opt2 from hemagglutinin__InfluenzaA__ADD22634
augaaggccauccucgucguccuccucugcaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95693 - RNA, 1701 nt, Artificial Sequence
  derived and/or modified sequence opt2 from hemagglutinin__InfluenzaA__ADD22645
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgagggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95694 - RNA, 1701 nt, Artificial Sequence
  derived and/or modified sequence opt2 from hemagglutinin__InfluenzaA__ADD22665
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95695 - RNA, 1701 nt, Artificial Sequence; identical to SEQ ID NO: 95283
  derived and/or modified sequence opt2 from hemagglutinin__InfluenzaA__ADD22675

SEQ ID NO: 95696 - RNA, 1701 nt, Artificial Sequence; identical to SEQ ID NO: 95283
  derived and/or modified sequence opt2 from hemagglutinin__InfluenzaA__ADD22685

SEQ ID NO: 95697 - RNA, 1701 nt, Artificial Sequence; identical to SEQ ID NO: 95283
  derived and/or modified sequence opt2 from hemagglutinin__InfluenzaA__ADD22695

SEQ ID NO: 95698 - RNA, 1701 nt, Artificial Sequence
  derived and/or modified sequence opt2 from hemagglutinin__InfluenzaA__ADD22722
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccuccuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95699 - RNA, 1701 nt, Artificial Sequence; identical to SEQ ID NO: 95681
  derived and/or modified sequence opt2 from hemagglutinin__InfluenzaA__ADD22732

SEQ ID NO: 95700 - RNA, 1701 nt, Artificial Sequence
  derived and/or modified sequence opt2 from hemagglutinin__InfluenzaA__ADD22742
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccuccuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95701 - RNA, 1701 nt, Artificial Sequence; identical to SEQ ID NO: 94181
  derived and/or modified sequence opt2 from hemagglutinin__InfluenzaA__ADD22752

SEQ ID NO: 95702 - RNA, 1701 nt, Artificial Sequence; identical to SEQ ID NO: 94272
  derived and/or modified sequence opt2 from hemagglutinin__InfluenzaA__ADD22762

SEQ ID NO: 95703 - RNA, 1701 nt, Artificial Sequence; identical to SEQ ID NO: 95283
  derived and/or modified sequence opt2 from hemagglutinin__InfluenzaA__ADD22772

SEQ ID NO: 95704 - RNA, 1701 nt, Artificial Sequence; identical to SEQ ID NO: 95283
  derived and/or modified sequence opt2 from hemagglutinin__InfluenzaA__ADD22782

SEQ ID NO: 95705 - RNA, 1701 nt, Artificial Sequence
  derived and/or modified sequence opt2 from hemagglutinin__InfluenzaA__ADD22792
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95706 - RNA, 1701 nt, Artificial Sequence; identical to SEQ ID NO: 95681
  derived and/or modified sequence opt2 from hemagglutinin__InfluenzaA__ADD22802

SEQ ID NO: 95707 - RNA, 1701 nt, Artificial Sequence; identical to SEQ ID NO: 95283
  derived and/or modified sequence opt2 from hemagglutinin__InfluenzaA__ADD22812

SEQ ID NO: 95708 - RNA, 1701 nt, Artificial Sequence
  derived and/or modified sequence opt2 from hemagglutinin__InfluenzaA__ADD22822
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccgccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95709 - RNA, 1701 nt, Artificial Sequence; identical to SEQ ID NO: 95283
  derived and/or modified sequence opt2 from hemagglutinin__InfluenzaA__ADD22832

SEQ ID NO: 95710 - RNA, 1701 nt, Artificial Sequence; identical to SEQ ID NO: 95283
  derived and/or modified sequence opt2 from hemagglutinin__InfluenzaA__ADD22842

SEQ ID NO: 95711 - RNA, 1701 nt, Artificial Sequence
  derived and/or modified sequence opt2 from hemagglutinin__InfluenzaA__ADD22852
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95712 - RNA, 1701 nt, Artificial Sequence
  derived and/or modified sequence opt2 from hemagglutinin__InfluenzaA__ADD22941
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaucuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95713 - RNA, 1701 nt, Artificial Sequence; identical to SEQ ID NO: 95283
  derived and/or modified sequence opt2 from hemagglutinin__InfluenzaA__ADD22951

SEQ ID NO: 95714 - RNA, 1701 nt, Artificial Sequence; identical to SEQ ID NO: 95283
  derived and/or modified sequence opt2 from hemagglutinin__InfluenzaA__ADD22961

SEQ ID NO: 95715 - RNA, 1701 nt, Artificial Sequence; identical to SEQ ID NO: 95283
  derived and/or modified sequence opt2 from hemagglutinin__InfluenzaA__ADD22971

SEQ ID NO: 95716 - RNA, 1701 nt, Artificial Sequence; identical to SEQ ID NO: 95283
  derived and/or modified sequence opt2 from hemagglutinin__InfluenzaA__ADD23072

SEQ ID NO: 95717 - RNA, 1701 nt, Artificial Sequence
  derived and/or modified sequence opt2 from hemagglutinin__InfluenzaA__ADD23082
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95718 - RNA, 1701 nt, Artificial Sequence
  derived and/or modified sequence opt2 from hemagglutinin__InfluenzaA__ADD23102
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95719 - RNA, 1701 nt, Artificial Sequence; identical to SEQ ID NO: 95283
  derived and/or modified sequence opt2 from hemagglutinin__InfluenzaA__ADD23112

SEQ ID NO: 95720 - RNA, 1701 nt, Artificial Sequence; identical to SEQ ID NO: 95283
  derived and/or modified sequence opt2 from hemagglutinin__InfluenzaA__ADD23122

SEQ ID NO: 95721 - RNA, 1701 nt, Artificial Sequence; identical to SEQ ID NO: 94181
  derived and/or modified sequence opt2 from hemagglutinin__InfluenzaA__ADD23132

SEQ ID NO: 95722 - RNA, 1701 nt, Artificial Sequence; identical to SEQ ID NO: 95345
  derived and/or modified sequence opt2 from hemagglutinin__InfluenzaA__ADD23142

SEQ ID NO: 95723 - RNA, 1701 nt, Artificial Sequence
  derived and/or modified sequence opt2 from hemagglutinin__InfluenzaA__ADD23162
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95724 - RNA, 1701 nt, Artificial Sequence; identical to SEQ ID NO: 95345
  derived and/or modified sequence opt2 from hemagglutinin__InfluenzaA__ADD23172

SEQ ID NO: 95725 - RNA, 1701 nt, Artificial Sequence; identical to SEQ ID NO: 95345
  derived and/or modified sequence opt2 from hemagglutinin__InfluenzaA__ADD23182

SEQ ID NO: 95726 - RNA, 1701 nt, Artificial Sequence; identical to SEQ ID NO: 95345
  derived and/or modified sequence opt2 from hemagglutinin__InfluenzaA__ADD23192

SEQ ID NO: 95727 - RNA, 1701 nt, Artificial Sequence; identical to SEQ ID NO: 95345
  derived and/or modified sequence opt2 from hemagglutinin__InfluenzaA__ADD23202

SEQ ID NO: 95728 - RNA, 1701 nt, Artificial Sequence; identical to SEQ ID NO: 95345
  derived and/or modified sequence opt2 from hemagglutinin__InfluenzaA__ADD23220

SEQ ID NO: 95729 - RNA, 1701 nt, Artificial Sequence; identical to SEQ ID NO: 95341
  derived and/or modified sequence opt2 from hemagglutinin__InfluenzaA__ADD23230

SEQ ID NO: 95730 - RNA, 1701 nt, Artificial Sequence; identical to SEQ ID NO: 95345
  derived and/or modified sequence opt2 from hemagglutinin__InfluenzaA__ADD23240

SEQ ID NO: 95731 - RNA, 1701 nt, Artificial Sequence
  derived and/or modified sequence opt2 from hemagglutinin__InfluenzaA__ADD23260
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95732 - RNA, 1701 nt, Artificial Sequence; identical to SEQ ID NO: 94534
  derived and/or modified sequence opt2 from hemagglutinin__InfluenzaA__ADD23280

SEQ ID NO: 95733 - RNA, 1701 nt, Artificial Sequence
  derived and/or modified sequence opt2 from hemagglutinin__InfluenzaA__ADD23290
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95734 - RNA, 1701 nt, Artificial Sequence; identical to SEQ ID NO: 95345
  derived and/or modified sequence opt2 from hemagglutinin__InfluenzaA__ADD23300

SEQ ID NO: 95735 - RNA, 1701 nt, Artificial Sequence; identical to SEQ ID NO: 95733
  derived and/or modified sequence opt2 from hemagglutinin__InfluenzaA__ADD23310

SEQ ID NO: 95736 - RNA, 1701 nt, Artificial Sequence; identical to SEQ ID NO: 95345
  derived and/or modified sequence opt2 from hemagglutinin__InfluenzaA__ADD23320

SEQ ID NO: 95737 - RNA, 1701 nt, Artificial Sequence
  derived and/or modified sequence opt2 from hemagglutinin__InfluenzaA__ADD23330
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95738 - RNA, 1701 nt, Artificial Sequence
  derived and/or modified sequence opt2 from hemagglutinin__InfluenzaA__ADD23355
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagauguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95739 - RNA, 1701 nt, Artificial Sequence; identical to SEQ ID NO: 95733
  derived and/or modified sequence opt2 from hemagglutinin__InfluenzaA__ADD23375

SEQ ID NO: 95740 - RNA, 1701 nt, Artificial Sequence; identical to SEQ ID NO: 95345
  derived and/or modified sequence opt2 from hemagglutinin__InfluenzaA__ADD23385

SEQ ID NO: 95741 - RNA, 1701 nt, Artificial Sequence
  derived and/or modified sequence opt2 from hemagglutinin__InfluenzaA__ADD23405
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccgucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95742 - RNA, 1701 nt, Artificial Sequence
  derived and/or modified sequence opt2 from hemagglutinin__InfluenzaA__ADD23415
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95743 - RNA, 1701 nt, Artificial Sequence; identical to SEQ ID NO: 95345
  derived and/or modified sequence opt2 from hemagglutinin__InfluenzaA__ADD23435

SEQ ID NO: 95744 - RNA, 1701 nt, Artificial Sequence
  derived and/or modified sequence opt2 from hemagglutinin__InfluenzaA__ADD23465
augaaggccauccucgccguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95745 - RNA, 1701 nt, Artificial Sequence; identical to SEQ ID NO: 95345
  derived and/or modified sequence opt2 from hemagglutinin__InfluenzaA__ADD23475

SEQ ID NO: 95746 - RNA, 1701 nt, Artificial Sequence; identical to SEQ ID NO: 95345
  derived and/or modified sequence opt2 from hemagglutinin__InfluenzaA__ADD23485

SEQ ID NO: 95747 - RNA, 1701 nt, Artificial Sequence
  derived and/or modified sequence opt2 from hemagglutinin__InfluenzaA__ADD23495
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgcccgcuccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95748 - RNA, 1701 nt, Artificial Sequence
  derived and/or modified sequence opt2 from hemagglutinin__InfluenzaA__ADD23505
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95749 - RNA, 1701 nt, Artificial Sequence; identical to SEQ ID NO: 95345
  derived and/or modified sequence opt2 from hemagglutinin__InfluenzaA__ADD23515

SEQ ID NO: 95750 - RNA, 1701 nt, Artificial Sequence; identical to SEQ ID NO: 95345
  derived and/or modified sequence opt2 from hemagglutinin__InfluenzaA__ADD23994

SEQ ID NO: 95751 - RNA, 1701 nt, Artificial Sequence
  derived and/or modified sequence opt2 from hemagglutinin__InfluenzaA__ADD24004
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95752 - RNA, 1701 nt, Artificial Sequence; identical to SEQ ID NO: 95283
  derived and/or modified sequence opt2 from hemagglutinin__InfluenzaA__ADD24014

SEQ ID NO: 95753 - RNA, 1701 nt, Artificial Sequence
  derived and/or modified sequence opt2 from hemagglutinin__InfluenzaA__ADD52537
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95754 - RNA, 1701 nt, Artificial Sequence; identical to SEQ ID NO: 95345
  derived and/or modified sequence opt2 from hemagglutinin__InfluenzaA__ADD64203

SEQ ID NO: 95755 - RNA, 1701 nt, Artificial Sequence
  derived and/or modified sequence opt2 from hemagglutinin__InfluenzaA__ADD64204
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgagaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgcccgcgagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95756 - RNA, 1701 nt, Artificial Sequence; identical to SEQ ID NO: 94181
  derived and/or modified sequence opt2 from hemagglutinin__InfluenzaA__ADD64205

SEQ ID NO: 95757 - RNA, 1701 nt, Artificial Sequence; identical to SEQ ID NO: 94181
  derived and/or modified sequence opt2 from hemagglutinin__InfluenzaA__ADD64206

SEQ ID NO: 95758 - RNA, 1701 nt, Artificial Sequence; identical to SEQ ID NO: 94979
  derived and/or modified sequence opt2 from hemagglutinin__InfluenzaA__ADD64207

SEQ ID NO: 95759 - RNA, 1701 nt, Artificial Sequence
  derived and/or modified sequence opt2 from hemagglutinin__InfluenzaA__ADD64208
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgaccccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95760 - RNA, 1701 nt, Artificial Sequence; identical to SEQ ID NO: 94979
  derived and/or modified sequence opt2 from hemagglutinin__InfluenzaA__ADD64209

SEQ ID NO: 95761 - RNA, 1701 nt, Artificial Sequence; identical to SEQ ID NO: 94181
  derived and/or modified sequence opt2 from hemagglutinin__InfluenzaA__ADD64210

SEQ ID NO: 95762 - RNA, 1701 nt, Artificial Sequence; identical to SEQ ID NO: 94979
  derived and/or modified sequence opt2 from hemagglutinin__InfluenzaA__ADD64211

SEQ ID NO: 95763 - RNA, 1701 nt, Artificial Sequence; identical to SEQ ID NO: 94181
  derived and/or modified sequence opt2 from hemagglutinin__InfluenzaA__ADD64212

SEQ ID NO: 95764 - RNA, 1701 nt, Artificial Sequence; identical to SEQ ID NO: 94979
  derived and/or modified sequence opt2 from hemagglutinin__InfluenzaA__ADD64213

SEQ ID NO: 95765 - RNA, 1701 nt, Artificial Sequence
  derived and/or modified sequence opt2 from hemagglutinin__InfluenzaA__ADD64214
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagaacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95766 - RNA, 1701 nt, Artificial Sequence; identical to SEQ ID NO: 94181
  derived and/or modified sequence opt2 from hemagglutinin__InfluenzaA__ADD64215

SEQ ID NO: 95767 - RNA, 1701 nt, Artificial Sequence; identical to SEQ ID NO: 94979
  derived and/or modified sequence opt2 from hemagglutinin__InfluenzaA__ADD64216

SEQ ID NO: 95768 - RNA, 1701 nt, Artificial Sequence; identical to SEQ ID NO: 94979
  derived and/or modified sequence opt2 from hemagglutinin__InfluenzaA__ADD64217

SEQ ID NO: 95769 - RNA, 1701 nt, Artificial Sequence
  derived and/or modified sequence opt2 from hemagglutinin__InfluenzaA__ADD74350
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95770 - RNA, 1701 nt, Artificial Sequence
  derived and/or modified sequence opt2 from hemagglutinin__InfluenzaA__ADD74360
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95771 - RNA, 1701 nt, Artificial Sequence; identical to SEQ ID NO: 94181
  derived and/or modified sequence opt2 from hemagglutinin__InfluenzaA__ADD74370

SEQ ID NO: 95772 - RNA, 1701 nt, Artificial Sequence; identical to SEQ ID NO: 94181
  derived and/or modified sequence opt2 from hemagglutinin__InfluenzaA__ADD74398

SEQ ID NO: 95773 - RNA, 1701 nt, Artificial Sequence
  derived and/or modified sequence opt2 from hemagglutinin__InfluenzaA__ADD74428
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95774 - RNA, 1701 nt, Artificial Sequence
  derived and/or modified sequence opt2 from hemagglutinin__InfluenzaA__ADD74438
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgagcccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95775 - RNA, 1701 nt, Artificial Sequence; identical to SEQ ID NO: 94181
  derived and/or modified sequence opt2 from hemagglutinin__InfluenzaA__ADD74448

SEQ ID NO: 95776 - RNA, 1701 nt, Artificial Sequence; identical to SEQ ID NO: 94181
  derived and/or modified sequence opt2 from hemagglutinin__InfluenzaA__ADD74458

SEQ ID NO: 95777 - RNA, 1701 nt, Artificial Sequence
  derived and/or modified sequence opt2 from hemagglutinin__InfluenzaA__ADD74468
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucaccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95778 - RNA, 1701 nt, Artificial Sequence
  derived and/or modified sequence opt2 from hemagglutinin__InfluenzaA__ADD74488
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95779 - RNA, 1701 nt, Artificial Sequence; identical to SEQ ID NO: 94181
  derived and/or modified sequence opt2 from hemagglutinin__InfluenzaA__ADD74498

SEQ ID NO: 95780 - RNA, 1701 nt, Artificial Sequence
  derived and/or modified sequence opt2 from hemagglutinin__InfluenzaA__ADD74508
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95781 - RNA, 1701 nt, Artificial Sequence
  derived and/or modified sequence opt2 from hemagglutinin__InfluenzaA__ADD74518
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95782 - RNA, 1701 nt, Artificial Sequence
  derived and/or modified sequence opt2 from hemagglutinin__InfluenzaA__ADD74528
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguuccagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95783 - RNA, 1701 nt, Artificial Sequence
  derived and/or modified sequence opt2 from hemagglutinin__InfluenzaA__ADD74538
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccgccuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucuacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95784 - RNA, 1701 nt, Artificial Sequence; identical to SEQ ID NO: 95778
  derived and/or modified sequence opt2 from hemagglutinin__InfluenzaA__ADD74548

SEQ ID NO: 95785 - RNA, 1701 nt, Artificial Sequence; identical to SEQ ID NO: 95345
  derived and/or modified sequence opt2 from hemagglutinin__InfluenzaA__ADD74558

SEQ ID NO: 95786 - RNA, 1701 nt, Artificial Sequence; identical to SEQ ID NO: 95733
  derived and/or modified sequence opt2 from hemagglutinin__InfluenzaA__ADD74568

SEQ ID NO: 95787 - RNA, 1701 nt, Artificial Sequence
  derived and/or modified sequence opt2 from hemagglutinin__InfluenzaA__ADD74578
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95788 - RNA, 1701 nt, Artificial Sequence
  derived and/or modified sequence opt2 from hemagglutinin__InfluenzaA__ADD74588
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgacggccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95789 - RNA, 1701 nt, Artificial Sequence; identical to SEQ ID NO: 95733
  derived and/or modified sequence opt2 from hemagglutinin__InfluenzaA__ADD74598

SEQ ID NO: 95790 - RNA, 1701 nt, Artificial Sequence; identical to SEQ ID NO: 95733
  derived and/or modified sequence opt2 from hemagglutinin__InfluenzaA__ADD74608

SEQ ID NO: 95791 - RNA, 1701 nt, Artificial Sequence; identical to SEQ ID NO: 95345
  derived and/or modified sequence opt2 from hemagglutinin__InfluenzaA__ADD74618

SEQ ID NO: 95792 - RNA, 1701 nt, Artificial Sequence
  derived and/or modified sequence opt2 from hemagglutinin__InfluenzaA__ADD74628
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95793 - RNA, 1701 nt, Artificial Sequence; identical to SEQ ID NO: 95282
  derived and/or modified sequence opt2 from hemagglutinin__InfluenzaA__ADD74648

SEQ ID NO: 95794 - RNA, 1701 nt, Artificial Sequence
  derived and/or modified sequence opt2 from hemagglutinin__InfluenzaA__ADD74658
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95795 - RNA, 1701 nt, Artificial Sequence; identical to SEQ ID NO: 95733
  derived and/or modified sequence opt2 from hemagglutinin__InfluenzaA__ADD74668

SEQ ID NO: 95796 - RNA, 1701 nt, Artificial Sequence; identical to SEQ ID NO: 95773
  derived and/or modified sequence opt2 from hemagglutinin__InfluenzaA__ADD74678

SEQ ID NO: 95797 - RNA, 1701 nt, Artificial Sequence; identical to SEQ ID NO: 95733
  derived and/or modified sequence opt2 from hemagglutinin__InfluenzaA__ADD74688

SEQ ID NO: 95798 - RNA, 1701 nt, Artificial Sequence
  derived and/or modified sequence opt2 from hemagglutinin__InfluenzaA__ADD74698
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95799 - RNA, 1701 nt, Artificial Sequence; identical to SEQ ID NO: 95733
  derived and/or modified sequence opt2 from hemagglutinin__InfluenzaA__ADD74708

SEQ ID NO: 95800 - RNA, 1701 nt, Artificial Sequence
  derived and/or modified sequence opt2 from hemagglutinin__InfluenzaA__ADD74728
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccuccgucguccucgucgucucccucggcgccaucuccuucuggaugugcuccaacggcucccuccagugccgcaucugcaucuga

SEQ ID NO: 95801 - RNA, 1701 nt, Artificial Sequence
  derived and/or modified sequence opt2 from hemagglutinin__InfluenzaA__ADD74738
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgcccgcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccggcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95802 - RNA, 1701 nt, Artificial Sequence; identical to SEQ ID NO: 95345
  derived and/or modified sequence opt2 from hemagglutinin__InfluenzaA__ADD74748

SEQ ID NO: 95803 - RNA, 1701 nt, Artificial Sequence; identical to SEQ ID NO: 95345
  derived and/or modified sequence opt2 from hemagglutinin__InfluenzaA__ADD74758

SEQ ID NO: 95804 - RNA, 1701 nt, Artificial Sequence
  derived and/or modified sequence opt2 from hemagglutinin__InfluenzaA__ADD74768
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcauguccuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95805 - RNA, 1701 nt, Artificial Sequence; identical to SEQ ID NO: 95345
  derived and/or modified sequence opt2 from hemagglutinin__InfluenzaA__ADD74778

SEQ ID NO: 95806 - RNA, 1701 nt, Artificial Sequence; identical to SEQ ID NO: 95733
  derived and/or modified sequence opt2 from hemagglutinin__InfluenzaA__ADD74788

SEQ ID NO: 95807 - RNA, 1701 nt, Artificial Sequence; identical to SEQ ID NO: 95733
  derived and/or modified sequence opt2 from hemagglutinin__InfluenzaA__ADD74798

SEQ ID NO: 95808 - RNA, 1701 nt, Artificial Sequence
  derived and/or modified sequence opt2 from hemagglutinin__InfluenzaA__ADD74808
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 95809 - RNA, 1701 nt, Artificial Sequence
  derived and/or modified sequence opt2 from hemagglutinin__InfluenzaA__ADD74818
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95810 - RNA, 1701 nt, Artificial Sequence
  derived and/or modified sequence opt2 from hemagglutinin__InfluenzaA__ADD74838
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95811 - RNA, 1701 nt, Artificial Sequence
  derived and/or modified sequence opt2 from hemagglutinin__InfluenzaA__ADD74848
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 95812 - RNA, 1701 nt, Artificial Sequence
  derived and/or modified sequence opt2 from hemagglutinin__InfluenzaA__ADD74858
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcaccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95813 - RNA, 1701 nt, Artificial Sequence; identical to SEQ ID NO: 95733
  derived and/or modified sequence opt2 from hemagglutinin__InfluenzaA__ADD74868

SEQ ID NO: 95814 - RNA, 1701 nt, Artificial Sequence; identical to SEQ ID NO: 95733
  derived and/or modified sequence opt2 from hemagglutinin__InfluenzaA__ADD74878

SEQ ID NO: 95815 - RNA, 1701 nt, Artificial Sequence
  derived and/or modified sequence opt2 from hemagglutinin__InfluenzaA__ADD74888
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95816 - RNA, 1701 nt, Artificial Sequence
  derived and/or modified sequence opt2 from hemagglutinin__InfluenzaA__ADD74898
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95817 - RNA, 1701 nt, Artificial Sequence
  derived and/or modified sequence opt2 from hemagglutinin__InfluenzaA__ADD74908
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95818 - RNA, 1701 nt, Artificial Sequence; identical to SEQ ID NO: 95811
  derived and/or modified sequence opt2 from hemagglutinin__InfluenzaA__ADD74918

SEQ ID NO: 95819 - RNA, 1701 nt, Artificial Sequence; identical to SEQ ID NO: 95733
  derived and/or modified sequence opt2 from hemagglutinin__InfluenzaA__ADD74928

SEQ ID NO: 95820 - RNA, 1701 nt, Artificial Sequence; identical to SEQ ID NO: 95811
  derived and/or modified sequence opt2 from hemagglutinin__InfluenzaA__ADD74938

SEQ ID NO: 95821 - RNA, 1701 nt, Artificial Sequence
  derived and/or modified sequence opt2 from hemagglutinin__InfluenzaA__ADD74958
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagaacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95822 - RNA, 1701 nt, Artificial Sequence; identical to SEQ ID NO: 95345
  derived and/or modified sequence opt2 from hemagglutinin__InfluenzaA__ADD74968

SEQ ID NO: 95823 - RNA, 1701 nt, Artificial Sequence
  derived and/or modified sequence opt2 from hemagglutinin__InfluenzaA__ADD74998
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcgcggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95824 - RNA, 1701 nt, Artificial Sequence; identical to SEQ ID NO: 95345
  derived and/or modified sequence opt2 from hemagglutinin__InfluenzaA__ADD75008

SEQ ID NO: 95825 - RNA, 1701 nt, Artificial Sequence; identical to SEQ ID NO: 95345
  derived and/or modified sequence opt2 from hemagglutinin__InfluenzaA__ADD75018

SEQ ID NO: 95826 - RNA, 1701 nt, Artificial Sequence; identical to SEQ ID NO: 95345
  derived and/or modified sequence opt2 from hemagglutinin__InfluenzaA__ADD75028

SEQ ID NO: 95827 - RNA, 1701 nt, Artificial Sequence; identical to SEQ ID NO: 95282
  derived and/or modified sequence opt2 from hemagglutinin__InfluenzaA__ADD75058

SEQ ID NO: 95828 - RNA, 1701 nt, Artificial Sequence; identical to SEQ ID NO: 95601
  derived and/or modified sequence opt2 from hemagglutinin__InfluenzaA__ADD75088

SEQ ID NO: 95829 - RNA, 1701 nt, Artificial Sequence; identical to SEQ ID NO: 94181
  derived and/or modified sequence opt2 from hemagglutinin__InfluenzaA__ADD75098

SEQ ID NO: 95830 - RNA, 1701 nt, Artificial Sequence
  derived and/or modified sequence opt2 from hemagglutinin__InfluenzaA__ADD75108
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95831 - RNA, 1701 nt, Artificial Sequence; identical to SEQ ID NO: 94181
  derived and/or modified sequence opt2 from hemagglutinin__InfluenzaA__ADD75118

SEQ ID NO: 95832 - RNA, 1701 nt, Artificial Sequence; identical to SEQ ID NO: 94628
  derived and/or modified sequence opt2 from hemagglutinin__InfluenzaA__ADD75128

SEQ ID NO: 95833 - RNA, 1701 nt, Artificial Sequence; identical to SEQ ID NO: 94181
  derived and/or modified sequence opt2 from hemagglutinin__InfluenzaA__ADD75138

SEQ ID NO: 95834 - RNA, 1701 nt, Artificial Sequence; identical to SEQ ID NO: 95345
  derived and/or modified sequence opt2 from hemagglutinin__InfluenzaA__ADD75148

SEQ ID NO: 95835 - RNA, 1701 nt, Artificial Sequence; identical to SEQ ID NO: 94181
  derived and/or modified sequence opt2 from hemagglutinin__InfluenzaA__ADD75158

SEQ ID NO: 95836 - RNA, 1701 nt, Artificial Sequence
  derived and/or modified sequence opt2 from hemagglutinin__InfluenzaA__ADD84494
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaucuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacggcugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95837 - RNA, 1701 nt, Artificial Sequence
  derived and/or modified sequence opt2 from hemagglutinin__InfluenzaA__ADD84495
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaucuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95838 - RNA, 1701 nt, Artificial Sequence
  derived and/or modified sequence opt2 from hemagglutinin__InfluenzaA__ADD84496
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaucuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95839 - RNA, 1701 nt, Artificial Sequence; identical to SEQ ID NO: 95837
  derived and/or modified sequence opt2 from hemagglutinin__InfluenzaA__ADD84497

SEQ ID NO: 95840 - RNA, 1701 nt, Artificial Sequence
  derived and/or modified sequence opt2 from hemagglutinin__InfluenzaA__ADD84498
augaaggccauccucgucguccuccucuacaccuucgccaccgccaacgccgacacccucugcaucggcuaccacgccaacaacuccaccgacaccgucgucaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaucuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95841 - RNA, 1701 nt, Artificial Sequence; identical to SEQ ID NO: 95837
  derived and/or modified sequence opt2 from hemagglutinin__InfluenzaA__ADD84499

SEQ ID NO: 95842 - RNA, 1701 nt, Artificial Sequence
  derived and/or modified sequence opt2 from hemagglutinin__InfluenzaA__ADD92535
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaaccgcgucaacuccgucaucgagaagaugaacacccaguucaccgccgucggcaaggaguucaaccaccucgagaagcgcaucgagaaccucaacaagaaggucgacggcggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95843 - RNA, 1701 nt, Artificial Sequence; identical to SEQ ID NO: 95769
  derived and/or modified sequence opt2 from hemagglutinin__InfluenzaA__ADD96766

SEQ ID NO: 95844 - RNA, 1701 nt, Artificial Sequence; identical to SEQ ID NO: 94361
  derived and/or modified sequence opt2 from hemagglutinin__InfluenzaA__ADD96776

SEQ ID NO: 95845 - RNA, 1701 nt, Artificial Sequence; identical to SEQ ID NO: 94361
  derived and/or modified sequence opt2 from hemagglutinin__InfluenzaA__ADD96786

SEQ ID NO: 95846 - RNA, 1701 nt, Artificial Sequence; identical to SEQ ID NO: 95666
  derived and/or modified sequence opt2 from hemagglutinin__InfluenzaA__ADD96796

SEQ ID NO: 95847 - RNA, 1701 nt, Artificial Sequence
  derived and/or modified sequence opt2 from hemagglutinin__InfluenzaA__ADD96806
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95848 - RNA, 1701 nt, Artificial Sequence; identical to SEQ ID NO: 95345
  derived and/or modified sequence opt2 from hemagglutinin__InfluenzaA__ADD96816

SEQ ID NO: 95849 - RNA, 1701 nt, Artificial Sequence
  derived and/or modified sequence opt2 from hemagglutinin__InfluenzaA__ADD96826
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaaggucauggaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucgccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95850 - RNA, 1701 nt, Artificial Sequence; identical to SEQ ID NO: 94181
  derived and/or modified sequence opt2 from hemagglutinin__InfluenzaA__ADD96836

SEQ ID NO: 95851 - RNA, 1701 nt, Artificial Sequence; identical to SEQ ID NO: 94181
  derived and/or modified sequence opt2 from hemagglutinin__InfluenzaA__ADD96846

SEQ ID NO: 95852 - RNA, 1701 nt, Artificial Sequence; identical to SEQ ID NO: 95733
  derived and/or modified sequence opt2 from hemagglutinin__InfluenzaA__ADD96856

SEQ ID NO: 95853 - RNA, 1701 nt, Artificial Sequence; identical to SEQ ID NO: 94534
  derived and/or modified sequence opt2 from hemagglutinin__InfluenzaA__ADD96886

SEQ ID NO: 95854 - RNA, 1701 nt, Artificial Sequence; identical to SEQ ID NO: 95808
  derived and/or modified sequence opt2 from hemagglutinin__InfluenzaA__ADD96896

SEQ ID NO: 95855 - RNA, 1701 nt, Artificial Sequence; identical to SEQ ID NO: 95345
  derived and/or modified sequence opt2 from hemagglutinin__InfluenzaA__ADD96906

SEQ ID NO: 95856 - RNA, 1701 nt, Artificial Sequence; identical to SEQ ID NO: 95345
  derived and/or modified sequence opt2 from hemagglutinin__InfluenzaA__ADD96916

SEQ ID NO: 95857 - RNA, 1701 nt, Artificial Sequence; identical to SEQ ID NO: 95345
  derived and/or modified sequence opt2 from hemagglutinin__InfluenzaA__ADD96926

SEQ ID NO: 95858 - RNA, 1701 nt, Artificial Sequence
  derived and/or modified sequence opt2 from hemagglutinin__InfluenzaA__ADD96936
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95859 - RNA, 1701 nt, Artificial Sequence
  derived and/or modified sequence opt2 from hemagglutinin__InfluenzaA__ADD96946
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95860 - RNA, 1701 nt, Artificial Sequence
  derived and/or modified sequence opt2 from hemagglutinin__InfluenzaA__ADD96956
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95861 - RNA, 1701 nt, Artificial Sequence; identical to SEQ ID NO: 94181
  derived and/or modified sequence opt2 from hemagglutinin__InfluenzaA__ADD96976

SEQ ID NO: 95862 - RNA, 1701 nt, Artificial Sequence; identical to SEQ ID NO: 94181
  derived and/or modified sequence opt2 from hemagglutinin__InfluenzaA__ADD96986

SEQ ID NO: 95863 - RNA, 1701 nt, Artificial Sequence
  derived and/or modified sequence opt2 from hemagglutinin__InfluenzaA__ADD97035
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95864 - RNA, 1701 nt, Artificial Sequence
  derived and/or modified sequence opt2 from hemagglutinin__InfluenzaA__ADD97045
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaccgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95865 - RNA, 1701 nt, Artificial Sequence; identical to SEQ ID NO: 95864
  derived and/or modified sequence opt2 from hemagglutinin__InfluenzaA__ADD97055

SEQ ID NO: 95866 - RNA, 1701 nt, Artificial Sequence; identical to SEQ ID NO: 95864
  derived and/or modified sequence opt2 from hemagglutinin__InfluenzaA__ADD97123

SEQ ID NO: 95867 - RNA, 1701 nt, Artificial Sequence
  derived and/or modified sequence opt2 from hemagglutinin__InfluenzaA__ADD97161
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaaguccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95868 - RNA, 1701 nt, Artificial Sequence
  derived and/or modified sequence opt2 from hemagglutinin__InfluenzaA__ADD97171
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccgucuccuucuggaugugcuccaacggcucccuccagugccgcaucugcaucuga

SEQ ID NO: 95869 - RNA, 1701 nt, Artificial Sequence; identical to SEQ ID NO: 94181
  derived and/or modified sequence opt2 from hemagglutinin__InfluenzaA__ADD97181

SEQ ID NO: 95870 - RNA, 1701 nt, Artificial Sequence; identical to SEQ ID NO: 94181
  derived and/or modified sequence opt2 from hemagglutinin__InfluenzaA__ADD97201

SEQ ID NO: 95871 - RNA, 1701 nt, Artificial Sequence; identical to SEQ ID NO: 95864
  derived and/or modified sequence opt2 from hemagglutinin__InfluenzaA__ADD97211

SEQ ID NO: 95872 - RNA, 1701 nt, Artificial Sequence; identical to SEQ ID NO: 94181
  derived and/or modified sequence opt2 from hemagglutinin__InfluenzaA__ADD97231

SEQ ID NO: 95873 - RNA, 1701 nt, Artificial Sequence
  derived and/or modified sequence opt2 from hemagglutinin__InfluenzaA__ADD97241
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaccgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95874 - RNA, 1701 nt, Artificial Sequence; identical to SEQ ID NO: 95864
  derived and/or modified sequence opt2 from hemagglutinin__InfluenzaA__ADD97251

SEQ ID NO: 95875 - RNA, 1701 nt, Artificial Sequence; identical to SEQ ID NO: 94181
  derived and/or modified sequence opt2 from hemagglutinin__InfluenzaA__ADD97261

SEQ ID NO: 95876 - RNA, 1701 nt, Artificial Sequence
  derived and/or modified sequence opt2 from hemagglutinin__InfluenzaA__ADD97271
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95877 - RNA, 1701 nt, Artificial Sequence; identical to SEQ ID NO: 95868
  derived and/or modified sequence opt2 from hemagglutinin__InfluenzaA__ADD97281

SEQ ID NO: 95878 - RNA, 1701 nt, Artificial Sequence; identical to SEQ ID NO: 94181
  derived and/or modified sequence opt2 from hemagglutinin__InfluenzaA__ADD97291

SEQ ID NO: 95879 - RNA, 1701 nt, Artificial Sequence
  derived and/or modified sequence opt2 from hemagglutinin__InfluenzaA__ADD97311
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccaucgccgaccagcagucccucuaccagaacgccgacgccuacgucuucgucggcaccucccgcuacuccaagaaguucaagcccgagaucgccauccgccccaagguccgcgaccaggagggccgcaugaaguacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95880 - RNA, 1701 nt, Artificial Sequence; identical to SEQ ID NO: 95864
  derived and/or modified sequence opt2 from hemagglutinin__InfluenzaA__ADD97321

SEQ ID NO: 95881 - RNA, 1701 nt, Artificial Sequence; identical to SEQ ID NO: 95345
  derived and/or modified sequence opt2 from hemagglutinin__InfluenzaA__ADD97331

SEQ ID NO: 95882 - RNA, 1701 nt, Artificial Sequence
  derived and/or modified sequence opt2 from hemagglutinin__InfluenzaA__ADD97341
augaaggccauccucgucguccuccucuacaccuucgccaccgucaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95883 - RNA, 1701 nt, Artificial Sequence; identical to SEQ ID NO: 95345
  derived and/or modified sequence opt2 from hemagglutinin__InfluenzaA__ADD97351

SEQ ID NO: 95884 - RNA, 1701 nt, Artificial Sequence; identical to SEQ ID NO: 95345
  derived and/or modified sequence opt2 from hemagglutinin__InfluenzaA__ADD97361

SEQ ID NO: 95885 - RNA, 1701 nt, Artificial Sequence
  derived and/or modified sequence opt2 from hemagglutinin__InfluenzaA__ADD97371
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcgucugcaucuga

SEQ ID NO: 95886 - RNA, 1701 nt, Artificial Sequence; identical to SEQ ID NO: 95345
  derived and/or modified sequence opt2 from hemagglutinin__InfluenzaA__ADD97381

SEQ ID NO: 95887 - RNA, 1701 nt, Artificial Sequence; identical to SEQ ID NO: 94181
  derived and/or modified sequence opt2 from hemagglutinin__InfluenzaA__ADD97391

SEQ ID NO: 95888 - RNA, 1701 nt, Artificial Sequence; identical to SEQ ID NO: 95345
  derived and/or modified sequence opt2 from hemagglutinin__InfluenzaA__ADD97411

SEQ ID NO: 95889 - RNA, 1701 nt, Artificial Sequence; identical to SEQ ID NO: 95345
  derived and/or modified sequence opt2 from hemagglutinin__InfluenzaA__ADD97421

SEQ ID NO: 95890 - RNA, 1701 nt, Artificial Sequence; identical to SEQ ID NO: 94181
  derived and/or modified sequence opt2 from hemagglutinin__InfluenzaA__ADD97431

SEQ ID NO: 95891 - RNA, 1701 nt, Artificial Sequence
  derived and/or modified sequence opt2 from hemagglutinin__InfluenzaA__ADD97441
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95892 - RNA, 1701 nt, Artificial Sequence; identical to SEQ ID NO: 95885
  derived and/or modified sequence opt2 from hemagglutinin__InfluenzaA__ADD97451

SEQ ID NO: 95893 - RNA, 1701 nt, Artificial Sequence; identical to SEQ ID NO: 95885
  derived and/or modified sequence opt2 from hemagglutinin__InfluenzaA__ADD97461

SEQ ID NO: 95894 - RNA, 1701 nt, Artificial Sequence; identical to SEQ ID NO: 95733
  derived and/or modified sequence opt2 from hemagglutinin__InfluenzaA__ADD97471

SEQ ID NO: 95895 - RNA, 1701 nt, Artificial Sequence; identical to SEQ ID NO: 95733
  derived and/or modified sequence opt2 from hemagglutinin__InfluenzaA__ADD97481

SEQ ID NO: 95896 - RNA, 1701 nt, Artificial Sequence
  derived and/or modified sequence opt2 from hemagglutinin__InfluenzaA__ADD97491
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgaggccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95897 - RNA, 1701 nt, Artificial Sequence; identical to SEQ ID NO: 95896
  derived and/or modified sequence opt2 from hemagglutinin__InfluenzaA__ADD97501

SEQ ID NO: 95898 - RNA, 1701 nt, Artificial Sequence; identical to SEQ ID NO: 94534
  derived and/or modified sequence opt2 from hemagglutinin__InfluenzaA__ADD97511

SEQ ID NO: 95899 - RNA, 1701 nt, Artificial Sequence
  derived and/or modified sequence opt2 from hemagglutinin__InfluenzaA__ADD97531
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccaucgccgaccagcagucccucuaccagaacgccgacgccuacgucuucgucggcaccucccgcuacuccaagaaguucaagcccgagaucgccauccgccccaagguccgcgaccaggagggccgcaugaaguacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95900 - RNA, 1701 nt, Artificial Sequence
  derived and/or modified sequence opt2 from hemagglutinin__InfluenzaA__ADD97541
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacaccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgcccacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95901 - RNA, 1701 nt, Artificial Sequence; identical to SEQ ID NO: 95733
  derived and/or modified sequence opt2 from hemagglutinin__InfluenzaA__ADD97551

SEQ ID NO: 95902 - RNA, 1701 nt, Artificial Sequence; identical to SEQ ID NO: 95345
  derived and/or modified sequence opt2 from hemagglutinin__InfluenzaA__ADD97561

SEQ ID NO: 95903 - RNA, 1701 nt, Artificial Sequence
  derived and/or modified sequence opt2 from hemagglutinin__InfluenzaA__ADD97571
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucucccucuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95904 - RNA, 1701 nt, Artificial Sequence; identical to SEQ ID NO: 94181
  derived and/or modified sequence opt2 from hemagglutinin__InfluenzaA__ADD97581

SEQ ID NO: 95905 - RNA, 1701 nt, Artificial Sequence; identical to SEQ ID NO: 94181
  derived and/or modified sequence opt2 from hemagglutinin__InfluenzaA__ADD97591

SEQ ID NO: 95906 - RNA, 1701 nt, Artificial Sequence; identical to SEQ ID NO: 94181
  derived and/or modified sequence opt2 from hemagglutinin__InfluenzaA__ADD97688

SEQ ID NO: 95907 - RNA, 1701 nt, Artificial Sequence; identical to SEQ ID NO: 95733
  derived and/or modified sequence opt2 from hemagglutinin__InfluenzaA__ADD97698

SEQ ID NO: 95908 - RNA, 1701 nt, Artificial Sequence; identical to SEQ ID NO: 95733
  derived and/or modified sequence opt2 from hemagglutinin__InfluenzaA__ADD97888

SEQ ID NO: 95909 - RNA, 1701 nt, Artificial Sequence
  derived and/or modified sequence opt2 from hemagglutinin__InfluenzaA__ADD97898
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95910 - RNA, 1701 nt, Artificial Sequence; identical to SEQ ID NO: 94534
  derived and/or modified sequence opt2 from hemagglutinin__InfluenzaA__ADD97908

SEQ ID NO: 95911 - RNA, 1701 nt, Artificial Sequence; identical to SEQ ID NO: 95345
  derived and/or modified sequence opt2 from hemagglutinin__InfluenzaA__ADD97918

SEQ ID NO: 95912 - RNA, 1701 nt, Artificial Sequence
  derived and/or modified sequence opt2 from hemagglutinin__InfluenzaA__ADD97928
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguuccaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95913 - RNA, 1701 nt, Artificial Sequence
  derived and/or modified sequence opt2 from hemagglutinin__InfluenzaA__ADD97938
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaugaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95914 - RNA, 1701 nt, Artificial Sequence
  derived and/or modified sequence opt2 from hemagglutinin__InfluenzaA__ADD97948
augaaggccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95915 - RNA, 1701 nt, Artificial Sequence
  derived and/or modified sequence opt2 from hemagglutinin__InfluenzaA__ADD97958
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguuccagcccgagaucgccauccgccccaagguccgcgaccaggagggccgcaugaacuacuacuggacccuccucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95916 - RNA, 1701 nt, Artificial Sequence; identical to SEQ ID NO: 94181
  derived and/or modified sequence opt2 from hemagglutinin__InfluenzaA__ADD97968

SEQ ID NO: 95917 - RNA, 1701 nt, Artificial Sequence; identical to SEQ ID NO: 95909
  derived and/or modified sequence opt2 from hemagglutinin__InfluenzaA__ADD97978

SEQ ID NO: 95918 - RNA, 1701 nt, Artificial Sequence; identical to SEQ ID NO: 95863
  derived and/or modified sequence opt2 from hemagglutinin__InfluenzaA__ADD97988

SEQ ID NO: 95919 - RNA, 1701 nt, Artificial Sequence
  derived and/or modified sequence opt2 from hemagglutinin__InfluenzaA__ADD97998
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgagauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95920 - RNA, 1701 nt, Artificial Sequence; identical to SEQ ID NO: 95733
  derived and/or modified sequence opt2 from hemagglutinin__InfluenzaA__ADD98008

SEQ ID NO: 95921 - RNA, 1701 nt, Artificial Sequence
  derived and/or modified sequence opt2 from hemagglutinin__InfluenzaA__ADD98018
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccacccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95922 - RNA, 1701 nt, Artificial Sequence; identical to SEQ ID NO: 95885
  derived and/or modified sequence opt2 from hemagglutinin__InfluenzaA__ADD98028

SEQ ID NO: 95923 - RNA, 1701 nt, Artificial Sequence
  derived and/or modified sequence opt2 from hemagglutinin__InfluenzaA__ADD98038
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccaucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgagauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95924 - RNA, 1701 nt, Artificial Sequence; identical to SEQ ID NO: 95909
  derived and/or modified sequence opt2 from hemagglutinin__InfluenzaA__ADD98048

SEQ ID NO: 95925 - RNA, 1701 nt, Artificial Sequence; identical to SEQ ID NO: 94181
  derived and/or modified sequence opt2 from hemagglutinin__InfluenzaA__ADD98058

SEQ ID NO: 95926 - RNA, 1701 nt, Artificial Sequence; identical to SEQ ID NO: 94181
  derived and/or modified sequence opt2 from hemagglutinin__InfluenzaA__ADD98068

SEQ ID NO: 95927 - RNA, 1701 nt, Artificial Sequence; identical to SEQ ID NO: 94423
  derived and/or modified sequence opt2 from hemagglutinin__InfluenzaA__ADD98078

SEQ ID NO: 95928 - RNA, 1701 nt, Artificial Sequence
  derived and/or modified sequence opt2 from hemagglutinin__InfluenzaA__ADD98098
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccuccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccgucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95929 - RNA, 1701 nt, Artificial Sequence; identical to SEQ ID NO: 95896
  derived and/or modified sequence opt2 from hemagglutinin__InfluenzaA__ADD98118

SEQ ID NO: 95930 - RNA, 1701 nt, Artificial Sequence; identical to SEQ ID NO: 95896
  derived and/or modified sequence opt2 from hemagglutinin__InfluenzaA__ADD98128

SEQ ID NO: 95931 - RNA, 1701 nt, Artificial Sequence
  derived and/or modified sequence opt2 from hemagglutinin__InfluenzaA__ADD98138
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95932 - RNA, 1701 nt, Artificial Sequence
  derived and/or modified sequence opt2 from hemagglutinin__InfluenzaA__ADD98148
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucuucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95933 - RNA, 1701 nt, Artificial Sequence
  derived and/or modified sequence opt2 from hemagglutinin__InfluenzaA__ADD98158
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcgagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucaucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95934 - RNA, 1701 nt, Artificial Sequence
  derived and/or modified sequence opt2 from hemagglutinin__InfluenzaA__ADD98168
augaaggccauccucgucguccuccucuacaccuucgccaccgccaacgccgacacccucugcaucggcuaccacgccaacaacuccaccgacaccgucgacaccguccucgagaagaacgucaccgucacccacuccaucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucguccccaaguacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95935 - RNA, 1701 nt, Artificial Sequence; identical to SEQ ID NO: 95353
  derived and/or modified sequence opt2 from hemagglutinin__InfluenzaA__ADD98188

SEQ ID NO: 95936 - RNA, 1701 nt, Artificial Sequence
  derived and/or modified sequence opt2 from hemagglutinin__InfluenzaA__ADD98198
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagaugcgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95937 - RNA, 1701 nt, Artificial Sequence; identical to SEQ ID NO: 94181
  derived and/or modified sequence opt2 from hemagglutinin__InfluenzaA__ADD98208

SEQ ID NO: 95938 - RNA, 1701 nt, Artificial Sequence; identical to SEQ ID NO: 94361
  derived and/or modified sequence opt2 from hemagglutinin__InfluenzaA__ADE20321

SEQ ID NO: 95939 - RNA, 1701 nt, Artificial Sequence; identical to SEQ ID NO: 94361
  derived and/or modified sequence opt2 from hemagglutinin__InfluenzaA__ADE20331

SEQ ID NO: 95940 - RNA, 1701 nt, Artificial Sequence; identical to SEQ ID NO: 94361
  derived and/or modified sequence opt2 from hemagglutinin__InfluenzaA__ADE20341

SEQ ID NO: 95941 - RNA, 1701 nt, Artificial Sequence; identical to SEQ ID NO: 95769
  derived and/or modified sequence opt2 from hemagglutinin__InfluenzaA__ADE20351

SEQ ID NO: 95942 - RNA, 1701 nt, Artificial Sequence; identical to SEQ ID NO: 94361
  derived and/or modified sequence opt2 from hemagglutinin__InfluenzaA__ADE20375

SEQ ID NO: 95943 - RNA, 1701 nt, Artificial Sequence; identical to SEQ ID NO: 95769
  derived and/or modified sequence opt2 from hemagglutinin__InfluenzaA__ADE20388

SEQ ID NO: 95944 - RNA, 1701 nt, Artificial Sequence; identical to SEQ ID NO: 94361
  derived and/or modified sequence opt2 from hemagglutinin__InfluenzaA__ADE20628

SEQ ID NO: 95945 - RNA, 1701 nt, Artificial Sequence; identical to SEQ ID NO: 95769
  derived and/or modified sequence opt2 from hemagglutinin__InfluenzaA__ADE20638

SEQ ID NO: 95946 - RNA, 1701 nt, Artificial Sequence; identical to SEQ ID NO: 94361
  derived and/or modified sequence opt2 from hemagglutinin__InfluenzaA__ADE20648

SEQ ID NO: 95947 - RNA, 1701 nt, Artificial Sequence; identical to SEQ ID NO: 94361
  derived and/or modified sequence opt2 from hemagglutinin__InfluenzaA__ADE20658

SEQ ID NO: 95948 - RNA, 1701 nt, Artificial Sequence; identical to SEQ ID NO: 95769
  derived and/or modified sequence opt2 from hemagglutinin__InfluenzaA__ADE20668

SEQ ID NO: 95949 - RNA, 1701 nt, Artificial Sequence; identical to SEQ ID NO: 95769
  derived and/or modified sequence opt2 from hemagglutinin__InfluenzaA__ADE20678

SEQ ID NO: 95950 - RNA, 1701 nt, Artificial Sequence; identical to SEQ ID NO: 94361
  derived and/or modified sequence opt2 from hemagglutinin__InfluenzaA__ADE20688

SEQ ID NO: 95951 - RNA, 1701 nt, Artificial Sequence; identical to SEQ ID NO: 94361
  derived and/or modified sequence opt2 from hemagglutinin__InfluenzaA__ADE20708

SEQ ID NO: 95952 - RNA, 1701 nt, Artificial Sequence; identical to SEQ ID NO: 94361
  derived and/or modified sequence opt2 from hemagglutinin__InfluenzaA__ADE20718

SEQ ID NO: 95953 - RNA, 1701 nt, Artificial Sequence
  derived and/or modified sequence opt2 from hemagglutinin__InfluenzaA__ADE20728
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95954 - RNA, 1701 nt, Artificial Sequence; identical to SEQ ID NO: 94361
  derived and/or modified sequence opt2 from hemagglutinin__InfluenzaA__ADE20738

SEQ ID NO: 95955 - RNA, 1701 nt, Artificial Sequence; identical to SEQ ID NO: 94361
  derived and/or modified sequence opt2 from hemagglutinin__InfluenzaA__ADE20748

SEQ ID NO: 95956 - RNA, 1701 nt, Artificial Sequence; identical to SEQ ID NO: 95953
  derived and/or modified sequence opt2 from hemagglutinin__InfluenzaA__ADE20758

SEQ ID NO: 95957 - RNA, 1701 nt, Artificial Sequence; identical to SEQ ID NO: 94361
  derived and/or modified sequence opt2 from hemagglutinin__InfluenzaA__ADE20768

SEQ ID NO: 95958 - RNA, 1701 nt, Artificial Sequence
  derived and/or modified sequence opt2 from hemagglutinin__InfluenzaA__ADE20778
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95959 - RNA, 1701 nt, Artificial Sequence; identical to SEQ ID NO: 95345
  derived and/or modified sequence opt2 from hemagglutinin__InfluenzaA__ADE20788

SEQ ID NO: 95960 - RNA, 1701 nt, Artificial Sequence
  derived and/or modified sequence opt2 from hemagglutinin__InfluenzaA__ADE20808
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95961 - RNA, 1701 nt, Artificial Sequence; identical to SEQ ID NO: 95345
  derived and/or modified sequence opt2 from hemagglutinin__InfluenzaA__ADE20818

SEQ ID NO: 95962 - RNA, 1701 nt, Artificial Sequence; identical to SEQ ID NO: 95903
  derived and/or modified sequence opt2 from hemagglutinin__InfluenzaA__ADE20828

SEQ ID NO: 95963 - RNA, 1701 nt, Artificial Sequence
  derived and/or modified sequence opt2 from hemagglutinin__InfluenzaA__ADE20848
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95964 - RNA, 1701 nt, Artificial Sequence; identical to SEQ ID NO: 95345
  derived and/or modified sequence opt2 from hemagglutinin__InfluenzaA__ADE20858

SEQ ID NO: 95965 - RNA, 1701 nt, Artificial Sequence
  derived and/or modified sequence opt2 from hemagglutinin__InfluenzaA__ADE20868
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucaccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95966 - RNA, 1701 nt, Artificial Sequence; identical to SEQ ID NO: 95899
  derived and/or modified sequence opt2 from hemagglutinin__InfluenzaA__ADE20878

SEQ ID NO: 95967 - RNA, 1701 nt, Artificial Sequence; identical to SEQ ID NO: 95283
  derived and/or modified sequence opt2 from hemagglutinin__InfluenzaA__ADE20888

SEQ ID NO: 95968 - RNA, 1701 nt, Artificial Sequence
  derived and/or modified sequence opt2 from hemagglutinin__InfluenzaA__ADE20898
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggagggcgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95969 - RNA, 1701 nt, Artificial Sequence; identical to SEQ ID NO: 95932
  derived and/or modified sequence opt2 from hemagglutinin__InfluenzaA__ADE20908

SEQ ID NO: 95970 - RNA, 1701 nt, Artificial Sequence
  derived and/or modified sequence opt2 from hemagglutinin__InfluenzaA__ADE20918
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggauccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95971 - RNA, 1701 nt, Artificial Sequence; identical to SEQ ID NO: 94534
  derived and/or modified sequence opt2 from hemagglutinin__InfluenzaA__ADE20928

SEQ ID NO: 95972 - RNA, 1701 nt, Artificial Sequence
  derived and/or modified sequence opt2 from hemagglutinin__InfluenzaA__ADE20948
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95973 - RNA, 1701 nt, Artificial Sequence
  derived and/or modified sequence opt2 from hemagglutinin__InfluenzaA__ADE20968
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgaggccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacuccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95974 - RNA, 1701 nt, Artificial Sequence; identical to SEQ ID NO: 95345
  derived and/or modified sequence opt2 from hemagglutinin__InfluenzaA__ADE20978

SEQ ID NO: 95975 - RNA, 1701 nt, Artificial Sequence
  derived and/or modified sequence opt2 from hemagglutinin__InfluenzaA__ADE20988
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaagcgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95976 - RNA, 1701 nt, Artificial Sequence; identical to SEQ ID NO: 95345
  derived and/or modified sequence opt2 from hemagglutinin__InfluenzaA__ADE20998

SEQ ID NO: 95977 - RNA, 1701 nt, Artificial Sequence; identical to SEQ ID NO: 95509
  derived and/or modified sequence opt2 from hemagglutinin__InfluenzaA__ADE21008

SEQ ID NO: 95978 - RNA, 1701 nt, Artificial Sequence
  derived and/or modified sequence opt2 from hemagglutinin__InfluenzaA__ADE21018
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95979 - RNA, 1701 nt, Artificial Sequence; identical to SEQ ID NO: 95919
  derived and/or modified sequence opt2 from hemagglutinin__InfluenzaA__ADE21028

SEQ ID NO: 95980 - RNA, 1701 nt, Artificial Sequence; identical to SEQ ID NO: 95909
  derived and/or modified sequence opt2 from hemagglutinin__InfluenzaA__ADE21038

SEQ ID NO: 95981 - RNA, 1701 nt, Artificial Sequence; identical to SEQ ID NO: 95932
  derived and/or modified sequence opt2 from hemagglutinin__InfluenzaA__ADE21048

SEQ ID NO: 95982 - RNA, 1701 nt, Artificial Sequence
  derived and/or modified sequence opt2 from hemagglutinin__InfluenzaA__ADE21058
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaucaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95983 - RNA, 1701 nt, Artificial Sequence
  derived and/or modified sequence opt2 from hemagglutinin__InfluenzaA__ADE21068
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95984 - RNA, 1698 nt, Artificial Sequence
  derived and/or modified sequence opt2 from hemagglutinin__InfluenzaA__ADE28761
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgaguccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucguccuccucgucucccucggcgccaucuccuucuggaugugcuccaacggcucccuccagugccgcaucugcaucuga

SEQ ID NO: 95985 - RNA, 1701 nt, Artificial Sequence; identical to SEQ ID NO: 94361
  derived and/or modified sequence opt2 from hemagglutinin__InfluenzaA__ADE28780

SEQ ID NO: 95986 - RNA, 1701 nt, Artificial Sequence; identical to SEQ ID NO: 95769
  derived and/or modified sequence opt2 from hemagglutinin__InfluenzaA__ADE28790

SEQ ID NO: 95987 - RNA, 1701 nt, Artificial Sequence; identical to SEQ ID NO: 95953
  derived and/or modified sequence opt2 from hemagglutinin__InfluenzaA__ADE28800

SEQ ID NO: 95988 - RNA, 1701 nt, Artificial Sequence; identical to SEQ ID NO: 95345
  derived and/or modified sequence opt2 from hemagglutinin__InfluenzaA__ADE28810

SEQ ID NO: 95989 - RNA, 1701 nt, Artificial Sequence
  derived and/or modified sequence opt2 from hemagglutinin__InfluenzaA__ADE28820
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcucccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 95990 - RNA, 1701 nt, Artificial Sequence; identical to SEQ ID NO: 94361
  derived and/or modified sequence opt2 from hemagglutinin__InfluenzaA__ADE28830

SEQ ID NO: 95991 - RNA, 1701 nt, Artificial Sequence; identical to SEQ ID NO: 94361
  derived and/or modified sequence opt2 from hemagglutinin__InfluenzaA__ADE28840

SEQ ID NO: 95992 - RNA, 1701 nt, Artificial Sequence; identical to SEQ ID NO: 94361
  derived and/or modified sequence opt2 from hemagglutinin__InfluenzaA__ADE28850

SEQ ID NO: 95993 - RNA, 1701 nt, Artificial Sequence; identical to SEQ ID NO: 94361
  derived and/or modified sequence opt2 from hemagglutinin__InfluenzaA__ADE28881

SEQ ID NO: 95994 - RNA, 1701 nt, Artificial Sequence; identical to SEQ ID NO: 94361
  derived and/or modified sequence opt2 from hemagglutinin__InfluenzaA__ADE28891

SEQ ID NO: 95995 - RNA, 1701 nt, Artificial Sequence; identical to SEQ ID NO: 95864
  derived and/or modified sequence opt2 from hemagglutinin__InfluenzaA__ADE28911

SEQ ID NO: 95996 - RNA, 1701 nt, Artificial Sequence; identical to SEQ ID NO: 95345
  derived and/or modified sequence opt2 from hemagglutinin__InfluenzaA__ADE28921

SEQ ID NO: 95997 - RNA, 1701 nt, Artificial Sequence; identical to SEQ ID NO: 95345
  derived and/or modified sequence opt2 from hemagglutinin__InfluenzaA__ADE28931

SEQ ID NO: 95998 - RNA, 1701 nt, Artificial Sequence; identical to SEQ ID NO: 94534
  derived and/or modified sequence opt2 from hemagglutinin__InfluenzaA__ADE28951

SEQ ID NO: 95999 - RNA, 1701 nt, Artificial Sequence
  derived and/or modified sequence opt2 from hemagglutinin__InfluenzaA__ADE28961
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacgucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96000 - RNA, 1701 nt, Artificial Sequence; identical to SEQ ID NO: 95885
  derived and/or modified sequence opt2 from hemagglutinin__InfluenzaA__ADE28971

SEQ ID NO: 96001 - RNA, 1701 nt, Artificial Sequence
  derived and/or modified sequence opt2 from hemagglutinin__InfluenzaA__ADE28981
augaaggccauccucgucguccuccucuacaccuucgccaccgccaacgccgacacccucugcaucggcuaccacgccaacaacuccaccgagaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96002 - RNA, 1701 nt, Artificial Sequence; identical to SEQ ID NO: 95345
  derived and/or modified sequence opt2 from hemagglutinin__InfluenzaA__ADE28991

SEQ ID NO: 96003 - RNA, 1701 nt, Artificial Sequence
  derived and/or modified sequence opt2 from hemagglutinin__InfluenzaA__ADE29001
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96004 - RNA, 1701 nt, Artificial Sequence; identical to SEQ ID NO: 94423
  derived and/or modified sequence opt2 from hemagglutinin__InfluenzaA__ADE29011

SEQ ID NO: 96005 - RNA, 1701 nt, Artificial Sequence
  derived and/or modified sequence opt2 from hemagglutinin__InfluenzaA__ADE29021
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuccgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96006 - RNA, 1701 nt, Artificial Sequence; identical to SEQ ID NO: 95830
  derived and/or modified sequence opt2 from hemagglutinin__InfluenzaA__ADE29031

SEQ ID NO: 96007 - RNA, 1701 nt, Artificial Sequence
  derived and/or modified sequence opt2 from hemagglutinin__InfluenzaA__ADE29041
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96008 - RNA, 1701 nt, Artificial Sequence; identical to SEQ ID NO: 95830
  derived and/or modified sequence opt2 from hemagglutinin__InfluenzaA__ADE29051

SEQ ID NO: 96009 - RNA, 1701 nt, Artificial Sequence
  derived and/or modified sequence opt2 from hemagglutinin__InfluenzaA__ADE29085
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaccuucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96010 - RNA, 1701 nt, Artificial Sequence
  derived and/or modified sequence opt2 from hemagglutinin__InfluenzaA__ADE29095
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaccuucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96011 - RNA, 1701 nt, Artificial Sequence; identical to SEQ ID NO: 95100
  derived and/or modified sequence opt2 from hemagglutinin__InfluenzaA__ADE34191

SEQ ID NO: 96012 - RNA, 1701 nt, Artificial Sequence; identical to SEQ ID NO: 95100
  derived and/or modified sequence opt2 from hemagglutinin__InfluenzaA__ADE34202

SEQ ID NO: 96013 - RNA, 1701 nt, Artificial Sequence
  derived and/or modified sequence opt2 from hemagglutinin__InfluenzaA__ADE34213
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgccgcaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96014 - RNA, 1701 nt, Artificial Sequence; identical to SEQ ID NO: 95100
  derived and/or modified sequence opt2 from hemagglutinin__InfluenzaA__ADE34224

SEQ ID NO: 96015 - RNA, 1701 nt, Artificial Sequence
  derived and/or modified sequence opt2 from hemagglutinin__InfluenzaA__ADE34235
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaccaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96016 - RNA, 1701 nt, Artificial Sequence; identical to SEQ ID NO: 95100
  derived and/or modified sequence opt2 from hemagglutinin__InfluenzaA__ADE34246

SEQ ID NO: 96017 - RNA, 1701 nt, Artificial Sequence; identical to SEQ ID NO: 95125
  derived and/or modified sequence opt2 from hemagglutinin__InfluenzaA__ADE34257

SEQ ID NO: 96018 - RNA, 1701 nt, Artificial Sequence
  derived and/or modified sequence opt2 from hemagglutinin__InfluenzaA__ADE34268
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgagguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96019 - RNA, 1701 nt, Artificial Sequence
  derived and/or modified sequence opt2 from hemagglutinin__InfluenzaA__ADE45499
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96020 - RNA, 1701 nt, Artificial Sequence; identical to SEQ ID NO: 94979
  derived and/or modified sequence opt2 from hemagglutinin__InfluenzaA__ADE45501

SEQ ID NO: 96021 - RNA, 1701 nt, Artificial Sequence
  derived and/or modified sequence opt2 from hemagglutinin__InfluenzaA__ADE45503
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 96022 - RNA, 1701 nt, Artificial Sequence; identical to SEQ ID NO: 94181
  derived and/or modified sequence opt2 from hemagglutinin__InfluenzaA__ADE45505

SEQ ID NO: 96023 - RNA, 1701 nt, Artificial Sequence; identical to SEQ ID NO: 94534
  derived and/or modified sequence opt2 from hemagglutinin__InfluenzaA__ADE45507

SEQ ID NO: 96024 - RNA, 1701 nt, Artificial Sequence; identical to SEQ ID NO: 94534
  derived and/or modified sequence opt2 from hemagglutinin__InfluenzaA__ADE45509

SEQ ID NO: 96025 - RNA, 1701 nt, Artificial Sequence; identical to SEQ ID NO: 94979
  derived and/or modified sequence opt2 from hemagglutinin__InfluenzaA__ADE45511

SEQ ID NO: 96026 - RNA, 1701 nt, Artificial Sequence
  derived and/or modified sequence opt2 from hemagglutinin__InfluenzaA__ADE45513
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaucaacuacuacuggacccucgucgagcccggcgacaagaucaucuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96027 - RNA, 1701 nt, Artificial Sequence
  derived and/or modified sequence opt2 from hemagglutinin__InfluenzaA__ADE75388
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgagaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96028 - RNA, 1701 nt, Artificial Sequence; identical to SEQ ID NO: 94181
  derived and/or modified sequence opt2 from hemagglutinin__InfluenzaA__ADE75390

SEQ ID NO: 96029 - RNA, 1701 nt, Artificial Sequence; identical to SEQ ID NO: 94181
  derived and/or modified sequence opt2 from hemagglutinin__InfluenzaA__ADF10067

SEQ ID NO: 96030 - RNA, 1701 nt, Artificial Sequence; identical to SEQ ID NO: 94181
  derived and/or modified sequence opt2 from hemagglutinin__InfluenzaA__ADF10077

SEQ ID NO: 96031 - RNA, 1701 nt, Artificial Sequence
  derived and/or modified sequence opt2 from hemagglutinin__InfluenzaA__ADF10087
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugaagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96032 - RNA, 1701 nt, Artificial Sequence
  derived and/or modified sequence opt2 from hemagglutinin__InfluenzaA__ADF10097
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96033 - RNA, 1701 nt, Artificial Sequence
  derived and/or modified sequence opt2 from hemagglutinin__InfluenzaA__ADF10107
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96034 - RNA, 1701 nt, Artificial Sequence; identical to SEQ ID NO: 94181
  derived and/or modified sequence opt2 from hemagglutinin__InfluenzaA__ADF10117

SEQ ID NO: 96035 - RNA, 1701 nt, Artificial Sequence; identical to SEQ ID NO: 95885
  derived and/or modified sequence opt2 from hemagglutinin__InfluenzaA__ADF10127

SEQ ID NO: 96036 - RNA, 1701 nt, Artificial Sequence; identical to SEQ ID NO: 94181
  derived and/or modified sequence opt2 from hemagglutinin__InfluenzaA__ADF10137

SEQ ID NO: 96037 - RNA, 1701 nt, Artificial Sequence
  derived and/or modified sequence opt2 from hemagglutinin__InfluenzaA__ADF10154
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagcgcguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96038 - RNA, 1701 nt, Artificial Sequence
  derived and/or modified sequence opt2 from hemagglutinin__InfluenzaA__ADF10174
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagcgcguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96039 - RNA, 1701 nt, Artificial Sequence; identical to SEQ ID NO: 96038
  derived and/or modified sequence opt2 from hemagglutinin__InfluenzaA__ADF10190

SEQ ID NO: 96040 - RNA, 1701 nt, Artificial Sequence; identical to SEQ ID NO: 95885
  derived and/or modified sequence opt2 from hemagglutinin__InfluenzaA__ADF10237

SEQ ID NO: 96041 - RNA, 1701 nt, Artificial Sequence; identical to SEQ ID NO: 96038
  derived and/or modified sequence opt2 from hemagglutinin__InfluenzaA__ADF10262

SEQ ID NO: 96042 - RNA, 1701 nt, Artificial Sequence
  derived and/or modified sequence opt2 from hemagglutinin__InfluenzaA__ADF10288
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagcgcguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcgucugcaucuga

SEQ ID NO: 96043 - RNA, 1701 nt, Artificial Sequence; identical to SEQ ID NO: 95885
  derived and/or modified sequence opt2 from hemagglutinin__InfluenzaA__ADF10302

SEQ ID NO: 96044 - RNA, 1701 nt, Artificial Sequence; identical to SEQ ID NO: 95885
  derived and/or modified sequence opt2 from hemagglutinin__InfluenzaA__ADF10335

SEQ ID NO: 96045 - RNA, 1701 nt, Artificial Sequence; identical to SEQ ID NO: 95885
  derived and/or modified sequence opt2 from hemagglutinin__InfluenzaA__ADF10359

SEQ ID NO: 96046 - RNA, 1701 nt, Artificial Sequence; identical to SEQ ID NO: 96038
  derived and/or modified sequence opt2 from hemagglutinin__InfluenzaA__ADF10369

SEQ ID NO: 96047 - RNA, 1701 nt, Artificial Sequence; identical to SEQ ID NO: 96038
  derived and/or modified sequence opt2 from hemagglutinin__InfluenzaA__ADF10390

SEQ ID NO: 96048 - RNA, 1701 nt, Artificial Sequence; identical to SEQ ID NO: 95885
  derived and/or modified sequence opt2 from hemagglutinin__InfluenzaA__ADF10528

SEQ ID NO: 96049 - RNA, 1701 nt, Artificial Sequence; identical to SEQ ID NO: 96038
  derived and/or modified sequence opt2 from hemagglutinin__InfluenzaA__ADF10598

SEQ ID NO: 96050 - RNA, 1701 nt, Artificial Sequence; identical to SEQ ID NO: 96038
  derived and/or modified sequence opt2 from hemagglutinin__InfluenzaA__ADF10670

SEQ ID NO: 96051 - RNA, 1701 nt, Artificial Sequence; identical to SEQ ID NO: 96038
  derived and/or modified sequence opt2 from hemagglutinin__InfluenzaA__ADF10724

SEQ ID NO: 96052 - RNA, 1701 nt, Artificial Sequence; identical to SEQ ID NO: 95885
  derived and/or modified sequence opt2 from hemagglutinin__InfluenzaA__ADF10757

SEQ ID NO: 96053 - RNA, 1701 nt, Artificial Sequence
  derived and/or modified sequence opt2 from hemagglutinin__InfluenzaA__ADF10828
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96054 - RNA, 1701 nt, Artificial Sequence; identical to SEQ ID NO: 94181
  derived and/or modified sequence opt2 from hemagglutinin__InfluenzaA__ADF10874

SEQ ID NO: 96055 - RNA, 1701 nt, Artificial Sequence; identical to SEQ ID NO: 94804
  derived and/or modified sequence opt2 from hemagglutinin__InfluenzaA__ADF10929

SEQ ID NO: 96056 - RNA, 1701 nt, Artificial Sequence; identical to SEQ ID NO: 94804
  derived and/or modified sequence opt2 from hemagglutinin__InfluenzaA__ADF10996

SEQ ID NO: 96057 - RNA, 1701 nt, Artificial Sequence; identical to SEQ ID NO: 94181
  derived and/or modified sequence opt2 from hemagglutinin__InfluenzaA__ADF27367

SEQ ID NO: 96058 - RNA, 1701 nt, Artificial Sequence; identical to SEQ ID NO: 94181
  derived and/or modified sequence opt2 from hemagglutinin__InfluenzaA__ADF27369

SEQ ID NO: 96059 - RNA, 1701 nt, Artificial Sequence
  derived and/or modified sequence opt2 from hemagglutinin__InfluenzaA__ADF27370
augaaggccauccucgucauccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacguccucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96060 - RNA, 1701 nt, Artificial Sequence; identical to SEQ ID NO: 95353
  derived and/or modified sequence opt2 from hemagglutinin__InfluenzaA__ADF27371

SEQ ID NO: 96061 - RNA, 1701 nt, Artificial Sequence
  derived and/or modified sequence opt2 from hemagglutinin__InfluenzaA__ADF27372
augaaggccauccucgucguccuccucuacaccuucgccaccgccaacgccgacacccucugcaucggcuaccacaccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96062 - RNA, 1701 nt, Artificial Sequence
  derived and/or modified sequence opt2 from hemagglutinin__InfluenzaA__ADF27373
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcucaucgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagacccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96063 - RNA, 1701 nt, Artificial Sequence; identical to SEQ ID NO: 94423
  derived and/or modified sequence opt2 from hemagglutinin__InfluenzaA__ADF27374

SEQ ID NO: 96064 - RNA, 1701 nt, Artificial Sequence
  derived and/or modified sequence opt2 from hemagglutinin__InfluenzaA__ADF27375
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacgagaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96065 - RNA, 1701 nt, Artificial Sequence
  derived and/or modified sequence opt2 from hemagglutinin__InfluenzaA__ADF27376
augaaggccauccucgucguccuccucuacaccuucgucaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgagauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96066 - RNA, 1701 nt, Artificial Sequence
  derived and/or modified sequence opt2 from hemagglutinin__InfluenzaA__ADF27378
augaaggccauccucgucguccuccucuacaccuucgucaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96067 - RNA, 1701 nt, Artificial Sequence
  derived and/or modified sequence opt2 from hemagglutinin__InfluenzaA__ADF27389
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaccuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96068 - RNA, 1701 nt, Artificial Sequence
  derived and/or modified sequence opt2 from hemagglutinin__InfluenzaA__ADF27399
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96069 - RNA, 1701 nt, Artificial Sequence; identical to SEQ ID NO: 95345
  derived and/or modified sequence opt2 from hemagglutinin__InfluenzaA__ADF27409

SEQ ID NO: 96070 - RNA, 1701 nt, Artificial Sequence; identical to SEQ ID NO: 96053
  derived and/or modified sequence opt2 from hemagglutinin__InfluenzaA__ADF27419

SEQ ID NO: 96071 - RNA, 1701 nt, Artificial Sequence
  derived and/or modified sequence opt2 from hemagglutinin__InfluenzaA__ADF27429
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguucuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcaugaaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96072 - RNA, 1701 nt, Artificial Sequence; identical to SEQ ID NO: 94181
  derived and/or modified sequence opt2 from hemagglutinin__InfluenzaA__ADF27439

SEQ ID NO: 96073 - RNA, 1701 nt, Artificial Sequence
  derived and/or modified sequence opt2 from hemagglutinin__InfluenzaA__ADF27449
augaaggccauccucgucguccuccucuacaccuucgccaccgucaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96074 - RNA, 1701 nt, Artificial Sequence; identical to SEQ ID NO: 95341
  derived and/or modified sequence opt2 from hemagglutinin__InfluenzaA__ADF27459

SEQ ID NO: 96075 - RNA, 1701 nt, Artificial Sequence; identical to SEQ ID NO: 94181
  derived and/or modified sequence opt2 from hemagglutinin__InfluenzaA__ADF27469

SEQ ID NO: 96076 - RNA, 1701 nt, Artificial Sequence
  derived and/or modified sequence opt2 from hemagglutinin__InfluenzaA__ADF27479
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccacucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96077 - RNA, 1701 nt, Artificial Sequence
  derived and/or modified sequence opt2 from hemagglutinin__InfluenzaA__ADF27489
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaguacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96078 - RNA, 1701 nt, Artificial Sequence; identical to SEQ ID NO: 95345
  derived and/or modified sequence opt2 from hemagglutinin__InfluenzaA__ADF27499

SEQ ID NO: 96079 - RNA, 1701 nt, Artificial Sequence; identical to SEQ ID NO: 94181
  derived and/or modified sequence opt2 from hemagglutinin__InfluenzaA__ADF27509

SEQ ID NO: 96080 - RNA, 1701 nt, Artificial Sequence; identical to SEQ ID NO: 95778
  derived and/or modified sequence opt2 from hemagglutinin__InfluenzaA__ADF27529

SEQ ID NO: 96081 - RNA, 1701 nt, Artificial Sequence; identical to SEQ ID NO: 95353
  derived and/or modified sequence opt2 from hemagglutinin__InfluenzaA__ADF27539

SEQ ID NO: 96082 - RNA, 1701 nt, Artificial Sequence; identical to SEQ ID NO: 95353
  derived and/or modified sequence opt2 from hemagglutinin__InfluenzaA__ADF27549

SEQ ID NO: 96083 - RNA, 1701 nt, Artificial Sequence; identical to SEQ ID NO: 94181
  derived and/or modified sequence opt2 from hemagglutinin__InfluenzaA__ADF27559

SEQ ID NO: 96084 - RNA, 1701 nt, Artificial Sequence
  derived and/or modified sequence opt2 from hemagglutinin__InfluenzaA__ADF27569
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcgucaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96085 - RNA, 1701 nt, Artificial Sequence; identical to SEQ ID NO: 95353
  derived and/or modified sequence opt2 from hemagglutinin__InfluenzaA__ADF27579

SEQ ID NO: 96086 - RNA, 1701 nt, Artificial Sequence
  derived and/or modified sequence opt2 from hemagglutinin__InfluenzaA__ADF27589
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96087 - RNA, 1701 nt, Artificial Sequence
  derived and/or modified sequence opt2 from hemagglutinin__InfluenzaA__ADF27599
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaaguccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96088 - RNA, 1701 nt, Artificial Sequence
  derived and/or modified sequence opt2 from hemagglutinin__InfluenzaA__ADF27609
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96089 - RNA, 1701 nt, Artificial Sequence
  derived and/or modified sequence opt2 from hemagglutinin__InfluenzaA__ADF27619
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgucccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96090 - RNA, 1701 nt, Artificial Sequence; identical to SEQ ID NO: 95353
  derived and/or modified sequence opt2 from hemagglutinin__InfluenzaA__ADF27629

SEQ ID NO: 96091 - RNA, 1701 nt, Artificial Sequence
  derived and/or modified sequence opt2 from hemagglutinin__InfluenzaA__ADF27649
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagccccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96092 - RNA, 1701 nt, Artificial Sequence; identical to SEQ ID NO: 95353
  derived and/or modified sequence opt2 from hemagglutinin__InfluenzaA__ADF27659

SEQ ID NO: 96093 - RNA, 1701 nt, Artificial Sequence; identical to SEQ ID NO: 95830
  derived and/or modified sequence opt2 from hemagglutinin__InfluenzaA__ADF27669

SEQ ID NO: 96094 - RNA, 1701 nt, Artificial Sequence; identical to SEQ ID NO: 95282
  derived and/or modified sequence opt2 from hemagglutinin__InfluenzaA__ADF27679

SEQ ID NO: 96095 - RNA, 1701 nt, Artificial Sequence; identical to SEQ ID NO: 95891
  derived and/or modified sequence opt2 from hemagglutinin__InfluenzaA__ADF27689

SEQ ID NO: 96096 - RNA, 1701 nt, Artificial Sequence
  derived and/or modified sequence opt2 from hemagglutinin__InfluenzaA__ADF27699
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96097 - RNA, 1701 nt, Artificial Sequence
  derived and/or modified sequence opt2 from hemagglutinin__InfluenzaA__ADF27709
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaucuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96098 - RNA, 1701 nt, Artificial Sequence; identical to SEQ ID NO: 95345
  derived and/or modified sequence opt2 from hemagglutinin__InfluenzaA__ADF27785

SEQ ID NO: 96099 - RNA, 1701 nt, Artificial Sequence
  derived and/or modified sequence opt2 from hemagglutinin__InfluenzaA__ADF27795
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96100 - RNA, 1701 nt, Artificial Sequence; identical to SEQ ID NO: 95353
  derived and/or modified sequence opt2 from hemagglutinin__InfluenzaA__ADF27805

SEQ ID NO: 96101 - RNA, 1701 nt, Artificial Sequence
  derived and/or modified sequence opt2 from hemagglutinin__InfluenzaA__ADF27815
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgacggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96102 - RNA, 1701 nt, Artificial Sequence
  derived and/or modified sequence opt2 from hemagglutinin__InfluenzaA__ADF27825
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuccgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96103 - RNA, 1701 nt, Artificial Sequence
  derived and/or modified sequence opt2 from hemagglutinin__InfluenzaA__ADF27845
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96104 - RNA, 1701 nt, Artificial Sequence; identical to SEQ ID NO: 95345
  derived and/or modified sequence opt2 from hemagglutinin__InfluenzaA__ADF27855

SEQ ID NO: 96105 - RNA, 1701 nt, Artificial Sequence; identical to SEQ ID NO: 95345
  derived and/or modified sequence opt2 from hemagglutinin__InfluenzaA__ADF27865

SEQ ID NO: 96106 - RNA, 1701 nt, Artificial Sequence; identical to SEQ ID NO: 95345
  derived and/or modified sequence opt2 from hemagglutinin__InfluenzaA__ADF27875

SEQ ID NO: 96107 - RNA, 1701 nt, Artificial Sequence; identical to SEQ ID NO: 95345
  derived and/or modified sequence opt2 from hemagglutinin__InfluenzaA__ADF27885

SEQ ID NO: 96108 - RNA, 1701 nt, Artificial Sequence; identical to SEQ ID NO: 94181
  derived and/or modified sequence opt2 from hemagglutinin__InfluenzaA__ADF27895

SEQ ID NO: 96109 - RNA, 1701 nt, Artificial Sequence
  derived and/or modified sequence opt2 from hemagglutinin__InfluenzaA__ADF27915
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccgccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96110 - RNA, 1701 nt, Artificial Sequence
  derived and/or modified sequence opt2 from hemagglutinin__InfluenzaA__ADF27925
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaacuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96111 - RNA, 1701 nt, Artificial Sequence
  derived and/or modified sequence opt2 from hemagglutinin__InfluenzaA__ADF27935
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccaagugcgagucccucuccaccgaguccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96112 - RNA, 1701 nt, Artificial Sequence
  derived and/or modified sequence opt2 from hemagglutinin__InfluenzaA__ADF27955
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaacuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96113 - RNA, 1701 nt, Artificial Sequence
  derived and/or modified sequence opt2 from hemagglutinin__InfluenzaA__ADF27965
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucaacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96114 - RNA, 1701 nt, Artificial Sequence; identical to SEQ ID NO: 95345
  derived and/or modified sequence opt2 from hemagglutinin__InfluenzaA__ADF27975

SEQ ID NO: 96115 - RNA, 1701 nt, Artificial Sequence; identical to SEQ ID NO: 95353
  derived and/or modified sequence opt2 from hemagglutinin__InfluenzaA__ADF27985

SEQ ID NO: 96116 - RNA, 1701 nt, Artificial Sequence
  derived and/or modified sequence opt2 from hemagglutinin__InfluenzaA__ADF27995
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96117 - RNA, 1701 nt, Artificial Sequence; identical to SEQ ID NO: 95733
  derived and/or modified sequence opt2 from hemagglutinin__InfluenzaA__ADF28005

SEQ ID NO: 96118 - RNA, 1701 nt, Artificial Sequence; identical to SEQ ID NO: 95733
  derived and/or modified sequence opt2 from hemagglutinin__InfluenzaA__ADF28015

SEQ ID NO: 96119 - RNA, 1701 nt, Artificial Sequence; identical to SEQ ID NO: 95345
  derived and/or modified sequence opt2 from hemagglutinin__InfluenzaA__ADF28025

SEQ ID NO: 96120 - RNA, 1701 nt, Artificial Sequence; identical to SEQ ID NO: 95345
  derived and/or modified sequence opt2 from hemagglutinin__InfluenzaA__ADF28045

SEQ ID NO: 96121 - RNA, 1701 nt, Artificial Sequence
  derived and/or modified sequence opt2 from hemagglutinin__InfluenzaA__ADF28055
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaacuacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96122 - RNA, 1701 nt, Artificial Sequence; identical to SEQ ID NO: 95345
  derived and/or modified sequence opt2 from hemagglutinin__InfluenzaA__ADF28065

SEQ ID NO: 96123 - RNA, 1701 nt, Artificial Sequence; identical to SEQ ID NO: 94363
  derived and/or modified sequence opt2 from hemagglutinin__InfluenzaA__ADF28075

SEQ ID NO: 96124 - RNA, 1701 nt, Artificial Sequence; identical to SEQ ID NO: 95282
  derived and/or modified sequence opt2 from hemagglutinin__InfluenzaA__ADF28085

SEQ ID NO: 96125 - RNA, 1701 nt, Artificial Sequence; identical to SEQ ID NO: 94361
  derived and/or modified sequence opt2 from hemagglutinin__InfluenzaA__ADF28107

SEQ ID NO: 96126 - RNA, 1701 nt, Artificial Sequence; identical to SEQ ID NO: 95733
  derived and/or modified sequence opt2 from hemagglutinin__InfluenzaA__ADF28117

SEQ ID NO: 96127 - RNA, 1701 nt, Artificial Sequence
  derived and/or modified sequence opt2 from hemagglutinin__InfluenzaA__ADF29918
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccgcuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96128 - RNA, 1701 nt, Artificial Sequence
  derived and/or modified sequence opt2 from hemagglutinin__InfluenzaA__ADF42689
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgccgucucccucggcgccaucggcuucuggaugugcuccaacggcucccuccagugccgcaucugcaucuga

SEQ ID NO: 96129 - RNA, 1701 nt, Artificial Sequence
  derived and/or modified sequence opt2 from hemagglutinin__InfluenzaA__ADF42699
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcacccucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96130 - RNA, 1701 nt, Artificial Sequence; identical to SEQ ID NO: 95345
  derived and/or modified sequence opt2 from hemagglutinin__InfluenzaA__ADF42709

SEQ ID NO: 96131 - RNA, 1701 nt, Artificial Sequence; identical to SEQ ID NO: 95345
  derived and/or modified sequence opt2 from hemagglutinin__InfluenzaA__ADF42719

SEQ ID NO: 96132 - RNA, 1701 nt, Artificial Sequence; identical to SEQ ID NO: 95345
  derived and/or modified sequence opt2 from hemagglutinin__InfluenzaA__ADF42729

SEQ ID NO: 96133 - RNA, 1701 nt, Artificial Sequence; identical to SEQ ID NO: 95345
  derived and/or modified sequence opt2 from hemagglutinin__InfluenzaA__ADF42739

SEQ ID NO: 96134 - RNA, 1701 nt, Artificial Sequence
  derived and/or modified sequence opt2 from hemagglutinin__InfluenzaA__ADF58349
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96135 - RNA, 1701 nt, Artificial Sequence; identical to SEQ ID NO: 95778
  derived and/or modified sequence opt2 from hemagglutinin__InfluenzaA__ADF58351

SEQ ID NO: 96136 - RNA, 1701 nt, Artificial Sequence
  derived and/or modified sequence opt2 from hemagglutinin__InfluenzaA__ADF80454
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccaucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96137 - RNA, 1701 nt, Artificial Sequence
  derived and/or modified sequence opt2 from hemagglutinin__InfluenzaA__ADF80462
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaucuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96138 - RNA, 1701 nt, Artificial Sequence; identical to SEQ ID NO: 94181
  derived and/or modified sequence opt2 from hemagglutinin__InfluenzaA__ADF80470

SEQ ID NO: 96139 - RNA, 1701 nt, Artificial Sequence
  derived and/or modified sequence opt2 from hemagglutinin__InfluenzaA__ADF80478
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96140 - RNA, 1701 nt, Artificial Sequence
  derived and/or modified sequence opt2 from hemagglutinin__InfluenzaA__ADF80494
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96141 - RNA, 1701 nt, Artificial Sequence; identical to SEQ ID NO: 96140
  derived and/or modified sequence opt2 from hemagglutinin__InfluenzaA__ADF80498

SEQ ID NO: 96142 - RNA, 1701 nt, Artificial Sequence; identical to SEQ ID NO: 94805
  derived and/or modified sequence opt2 from hemagglutinin__InfluenzaA__ADF80502

SEQ ID NO: 96143 - RNA, 1701 nt, Artificial Sequence
  derived and/or modified sequence opt2 from hemagglutinin__InfluenzaA__ADF80506
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcuccaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96144 - RNA, 1701 nt, Artificial Sequence
  derived and/or modified sequence opt2 from hemagglutinin__InfluenzaA__ADF83741
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgcccccaucggcaagugcaacuccgacugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96145 - RNA, 1701 nt, Artificial Sequence; identical to SEQ ID NO: 94923
  derived and/or modified sequence opt2 from hemagglutinin__InfluenzaA__ADF83752

SEQ ID NO: 96146 - RNA, 1701 nt, Artificial Sequence; identical to SEQ ID NO: 95733
  derived and/or modified sequence opt2 from hemagglutinin__InfluenzaA__ADF83763

SEQ ID NO: 96147 - RNA, 1701 nt, Artificial Sequence; identical to SEQ ID NO: 95733
  derived and/or modified sequence opt2 from hemagglutinin__InfluenzaA__ADF83773

SEQ ID NO: 96148 - RNA, 1701 nt, Artificial Sequence
  derived and/or modified sequence opt2 from hemagglutinin__InfluenzaA__ADF83783
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaccaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96149 - RNA, 1701 nt, Artificial Sequence; identical to SEQ ID NO: 95808
  derived and/or modified sequence opt2 from hemagglutinin__InfluenzaA__ADF83793

SEQ ID NO: 96150 - RNA, 1701 nt, Artificial Sequence
  derived and/or modified sequence opt2 from hemagglutinin__InfluenzaA__ADF83803
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96151 - RNA, 1701 nt, Artificial Sequence
  derived and/or modified sequence opt2 from hemagglutinin__InfluenzaA__ADF83813
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96152 - RNA, 1701 nt, Artificial Sequence
  derived and/or modified sequence opt2 from hemagglutinin__InfluenzaA__ADF83823
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96153 - RNA, 1701 nt, Artificial Sequence; identical to SEQ ID NO: 95733
  derived and/or modified sequence opt2 from hemagglutinin__InfluenzaA__ADF83833

SEQ ID NO: 96154 - RNA, 1701 nt, Artificial Sequence; identical to SEQ ID NO: 95733
  derived and/or modified sequence opt2 from hemagglutinin__InfluenzaA__ADF83843

SEQ ID NO: 96155 - RNA, 1701 nt, Artificial Sequence; identical to SEQ ID NO: 95733
  derived and/or modified sequence opt2 from hemagglutinin__InfluenzaA__ADF83853

SEQ ID NO: 96156 - RNA, 1701 nt, Artificial Sequence
  derived and/or modified sequence opt2 from hemagglutinin__InfluenzaA__ADF83873
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96157 - RNA, 1701 nt, Artificial Sequence; identical to SEQ ID NO: 95345
  derived and/or modified sequence opt2 from hemagglutinin__InfluenzaA__ADF83885

SEQ ID NO: 96158 - RNA, 1701 nt, Artificial Sequence
  derived and/or modified sequence opt2 from hemagglutinin__InfluenzaA__ADF83895
augaaggccauccucgucguccuccucuacaccuucgccaccgucaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96159 - RNA, 1701 nt, Artificial Sequence; identical to SEQ ID NO: 95733
  derived and/or modified sequence opt2 from hemagglutinin__InfluenzaA__ADF83915

SEQ ID NO: 96160 - RNA, 1701 nt, Artificial Sequence
  derived and/or modified sequence opt2 from hemagglutinin__InfluenzaA__ADF84441
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccucccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96161 - RNA, 1701 nt, Artificial Sequence; identical to SEQ ID NO: 95345
  derived and/or modified sequence opt2 from hemagglutinin__InfluenzaA__ADF84459

SEQ ID NO: 96162 - RNA, 1701 nt, Artificial Sequence; identical to SEQ ID NO: 95733
  derived and/or modified sequence opt2 from hemagglutinin__InfluenzaA__ADF84469

SEQ ID NO: 96163 - RNA, 1701 nt, Artificial Sequence; identical to SEQ ID NO: 95794
  derived and/or modified sequence opt2 from hemagglutinin__InfluenzaA__ADF84479

SEQ ID NO: 96164 - RNA, 1701 nt, Artificial Sequence; identical to SEQ ID NO: 95733
  derived and/or modified sequence opt2 from hemagglutinin__InfluenzaA__ADF84489

SEQ ID NO: 96165 - RNA, 1701 nt, Artificial Sequence; identical to SEQ ID NO: 95733
  derived and/or modified sequence opt2 from hemagglutinin__InfluenzaA__ADF85017

SEQ ID NO: 96166 - RNA, 1701 nt, Artificial Sequence; identical to SEQ ID NO: 95733
  derived and/or modified sequence opt2 from hemagglutinin__InfluenzaA__ADF87152

SEQ ID NO: 96167 - RNA, 1701 nt, Artificial Sequence
  derived and/or modified sequence opt2 from hemagglutinin__InfluenzaA__ADF87162
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96168 - RNA, 1701 nt, Artificial Sequence; identical to SEQ ID NO: 95733
  derived and/or modified sequence opt2 from hemagglutinin__InfluenzaA__ADF87172

SEQ ID NO: 96169 - RNA, 1701 nt, Artificial Sequence
  derived and/or modified sequence opt2 from hemagglutinin__InfluenzaA__ADF87182
augaacgccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96170 - RNA, 1701 nt, Artificial Sequence; identical to SEQ ID NO: 95733
  derived and/or modified sequence opt2 from hemagglutinin__InfluenzaA__ADF87192

SEQ ID NO: 96171 - RNA, 1701 nt, Artificial Sequence
  derived and/or modified sequence opt2 from hemagglutinin__InfluenzaA__ADF87202
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuucgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96172 - RNA, 1701 nt, Artificial Sequence; identical to SEQ ID NO: 95733
  derived and/or modified sequence opt2 from hemagglutinin__InfluenzaA__ADF87212

SEQ ID NO: 96173 - RNA, 1701 nt, Artificial Sequence; identical to SEQ ID NO: 95896
  derived and/or modified sequence opt2 from hemagglutinin__InfluenzaA__ADF87232

SEQ ID NO: 96174 - RNA, 1701 nt, Artificial Sequence; identical to SEQ ID NO: 95733
  derived and/or modified sequence opt2 from hemagglutinin__InfluenzaA__ADF87242

SEQ ID NO: 96175 - RNA, 1701 nt, Artificial Sequence
  derived and/or modified sequence opt2 from hemagglutinin__InfluenzaA__ADF87252
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaaguccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96176 - RNA, 1701 nt, Artificial Sequence; identical to SEQ ID NO: 95733
  derived and/or modified sequence opt2 from hemagglutinin__InfluenzaA__ADF87262

SEQ ID NO: 96177 - RNA, 1701 nt, Artificial Sequence; identical to SEQ ID NO: 95345
  derived and/or modified sequence opt2 from hemagglutinin__InfluenzaA__ADF87272

SEQ ID NO: 96178 - RNA, 1701 nt, Artificial Sequence; identical to SEQ ID NO: 95345
  derived and/or modified sequence opt2 from hemagglutinin__InfluenzaA__ADF87282

SEQ ID NO: 96179 - RNA, 1701 nt, Artificial Sequence
  derived and/or modified sequence opt2 from hemagglutinin__InfluenzaA__ADF87292
augaaggccauccucgucguccuccucuacaccuucgccaccgccaacgccgacacccucugcaucggcuaccacgccaacaacuccaccgacaccgucgacaccguccucaagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccggcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96180 - RNA, 1701 nt, Artificial Sequence; identical to SEQ ID NO: 95345
  derived and/or modified sequence opt2 from hemagglutinin__InfluenzaA__ADF87302

SEQ ID NO: 96181 - RNA, 1701 nt, Artificial Sequence
  derived and/or modified sequence opt2 from hemagglutinin__InfluenzaA__ADF87331
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96182 - RNA, 1701 nt, Artificial Sequence; identical to SEQ ID NO: 94181
  derived and/or modified sequence opt2 from hemagglutinin__InfluenzaA__ADF87341

SEQ ID NO: 96183 - RNA, 1701 nt, Artificial Sequence
  derived and/or modified sequence opt2 from hemagglutinin__InfluenzaA__ADF87351
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgacucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96184 - RNA, 1701 nt, Artificial Sequence; identical to SEQ ID NO: 95808
  derived and/or modified sequence opt2 from hemagglutinin__InfluenzaA__ADF87361

SEQ ID NO: 96185 - RNA, 1701 nt, Artificial Sequence; identical to SEQ ID NO: 95345
  derived and/or modified sequence opt2 from hemagglutinin__InfluenzaA__ADF87371

SEQ ID NO: 96186 - RNA, 1701 nt, Artificial Sequence
  derived and/or modified sequence opt2 from hemagglutinin__InfluenzaA__ADG08115
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96187 - RNA, 1701 nt, Artificial Sequence; identical to SEQ ID NO: 94923
  derived and/or modified sequence opt2 from hemagglutinin__InfluenzaA__ADG21004

SEQ ID NO: 96188 - RNA, 1701 nt, Artificial Sequence; identical to SEQ ID NO: 94923
  derived and/or modified sequence opt2 from hemagglutinin__InfluenzaA__ADG21006

SEQ ID NO: 96189 - RNA, 1701 nt, Artificial Sequence
  derived and/or modified sequence opt2 from hemagglutinin__InfluenzaA__ADG21008
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaguccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96190 - RNA, 1701 nt, Artificial Sequence
  derived and/or modified sequence opt2 from hemagglutinin__InfluenzaA__ADG21009
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96191 - RNA, 1701 nt, Artificial Sequence; identical to SEQ ID NO: 94923
  derived and/or modified sequence opt2 from hemagglutinin__InfluenzaA__ADG21010

SEQ ID NO: 96192 - RNA, 1701 nt, Artificial Sequence
  derived and/or modified sequence opt2 from hemagglutinin__InfluenzaA__ADG21011
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96193 - RNA, 1701 nt, Artificial Sequence; identical to SEQ ID NO: 94923
  derived and/or modified sequence opt2 from hemagglutinin__InfluenzaA__ADG21012

SEQ ID NO: 96194 - RNA, 1701 nt, Artificial Sequence; identical to SEQ ID NO: 94923
  derived and/or modified sequence opt2 from hemagglutinin__InfluenzaA__ADG21013

SEQ ID NO: 96195 - RNA, 1701 nt, Artificial Sequence
  derived and/or modified sequence opt2 from hemagglutinin__InfluenzaA__ADG21014
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96196 - RNA, 1701 nt, Artificial Sequence
  derived and/or modified sequence opt2 from hemagglutinin__InfluenzaA__ADG21017
augaagaccaucaucgcccucuccuacauccucuaccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96197 - RNA, 1701 nt, Artificial Sequence
  derived and/or modified sequence opt2 from hemagglutinin__InfluenzaA__ADG21018
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgccaccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96198 - RNA, 1701 nt, Artificial Sequence
  derived and/or modified sequence opt2 from hemagglutinin__InfluenzaA__ADG21019
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacacccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggcaagaucaucgucuccaccaagcgcucccagcagaccgucauccccaacaucggcucccgcccccgcguccgcaacauccccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96199 - RNA, 1701 nt, Artificial Sequence
  derived and/or modified sequence opt2 from hemagglutinin__InfluenzaA__ADG21020
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaguccggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaucgucuccaccaagcgcucccagcagaccgucacccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96200 - RNA, 1701 nt, Artificial Sequence; identical to SEQ ID NO: 93946
  derived and/or modified sequence opt2 from hemagglutinin__InfluenzaA__ADG21022

SEQ ID NO: 96201 - RNA, 1701 nt, Artificial Sequence; identical to SEQ ID NO: 93946
  derived and/or modified sequence opt2 from hemagglutinin__InfluenzaA__ADG21023

SEQ ID NO: 96202 - RNA, 1701 nt, Artificial Sequence
  derived and/or modified sequence opt2 from hemagglutinin__InfluenzaA__ADG21024
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcgcccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96203 - RNA, 1701 nt, Artificial Sequence
  derived and/or modified sequence opt2 from hemagglutinin__InfluenzaA__ADG21026
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgccuccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96204 - RNA, 1701 nt, Artificial Sequence; identical to SEQ ID NO: 94181
  derived and/or modified sequence opt2 from hemagglutinin__InfluenzaA__ADG21037

SEQ ID NO: 96205 - RNA, 1701 nt, Artificial Sequence
  derived and/or modified sequence opt2 from hemagglutinin__InfluenzaA__ADG21038
augaaggccauccucgucguccuccucuacaccuucgccaccgccgacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96206 - RNA, 1701 nt, Artificial Sequence
  derived and/or modified sequence opt2 from hemagglutinin__InfluenzaA__ADG21040
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 96207 - RNA, 1701 nt, Artificial Sequence
  derived and/or modified sequence opt2 from hemagglutinin__InfluenzaA__ADG21041
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccgucuccuucuggaugugcuccaacggcucccuccagugccgcaucugcaucuga

SEQ ID NO: 96208 - RNA, 1701 nt, Artificial Sequence; identical to SEQ ID NO: 95282
  derived and/or modified sequence opt2 from hemagglutinin__InfluenzaA__ADG21042

SEQ ID NO: 96209 - RNA, 1701 nt, Artificial Sequence
  derived and/or modified sequence opt2 from hemagglutinin__InfluenzaA__ADG21043
augaaggccauccucgucguccuccucuacaccuucaccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96210 - RNA, 1701 nt, Artificial Sequence
  derived and/or modified sequence opt2 from hemagglutinin__InfluenzaA__ADG21045
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96211 - RNA, 1701 nt, Artificial Sequence; identical to SEQ ID NO: 96210
  derived and/or modified sequence opt2 from hemagglutinin__InfluenzaA__ADG21046

SEQ ID NO: 96212 - RNA, 1701 nt, Artificial Sequence; identical to SEQ ID NO: 95345
  derived and/or modified sequence opt2 from hemagglutinin__InfluenzaA__ADG21048

SEQ ID NO: 96213 - RNA, 1701 nt, Artificial Sequence
  derived and/or modified sequence opt2 from hemagglutinin__InfluenzaA__ADG21049
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96214 - RNA, 1701 nt, Artificial Sequence; identical to SEQ ID NO: 94534
  derived and/or modified sequence opt2 from hemagglutinin__InfluenzaA__ADG21122

SEQ ID NO: 96215 - RNA, 1701 nt, Artificial Sequence; identical to SEQ ID NO: 95345
  derived and/or modified sequence opt2 from hemagglutinin__InfluenzaA__ADG21123

SEQ ID NO: 96216 - RNA, 1701 nt, Artificial Sequence; identical to SEQ ID NO: 94181
  derived and/or modified sequence opt2 from hemagglutinin__InfluenzaA__ADG21124

SEQ ID NO: 96217 - RNA, 1701 nt, Artificial Sequence
  derived and/or modified sequence opt2 from hemagglutinin__InfluenzaA__ADG21125
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96218 - RNA, 1701 nt, Artificial Sequence; identical to SEQ ID NO: 94168
  derived and/or modified sequence opt2 from hemagglutinin__InfluenzaA__ADG21126

SEQ ID NO: 96219 - RNA, 1701 nt, Artificial Sequence; identical to SEQ ID NO: 94168
  derived and/or modified sequence opt2 from hemagglutinin__InfluenzaA__ADG21127

SEQ ID NO: 96220 - RNA, 1701 nt, Artificial Sequence; identical to SEQ ID NO: 94168
  derived and/or modified sequence opt2 from hemagglutinin__InfluenzaA__ADG21128

SEQ ID NO: 96221 - RNA, 1701 nt, Artificial Sequence; identical to SEQ ID NO: 94168
  derived and/or modified sequence opt2 from hemagglutinin__InfluenzaA__ADG21129

SEQ ID NO: 96222 - RNA, 1701 nt, Artificial Sequence; identical to SEQ ID NO: 94181
  derived and/or modified sequence opt2 from hemagglutinin__InfluenzaA__ADG21130

SEQ ID NO: 96223 - RNA, 1701 nt, Artificial Sequence; identical to SEQ ID NO: 94168
  derived and/or modified sequence opt2 from hemagglutinin__InfluenzaA__ADG21131

SEQ ID NO: 96224 - RNA, 1701 nt, Artificial Sequence; identical to SEQ ID NO: 94168
  derived and/or modified sequence opt2 from hemagglutinin__InfluenzaA__ADG21132

SEQ ID NO: 96225 - RNA, 1701 nt, Artificial Sequence; identical to SEQ ID NO: 94168
  derived and/or modified sequence opt2 from hemagglutinin__InfluenzaA__ADG21133

SEQ ID NO: 96226 - RNA, 1701 nt, Artificial Sequence; identical to SEQ ID NO: 94168
  derived and/or modified sequence opt2 from hemagglutinin__InfluenzaA__ADG21134

SEQ ID NO: 96227 - RNA, 1701 nt, Artificial Sequence; identical to SEQ ID NO: 94168
  derived and/or modified sequence opt2 from hemagglutinin__InfluenzaA__ADG21135

SEQ ID NO: 96228 - RNA, 1701 nt, Artificial Sequence; identical to SEQ ID NO: 94168
  derived and/or modified sequence opt2 from hemagglutinin__InfluenzaA__ADG21136

SEQ ID NO: 96229 - RNA, 1701 nt, Artificial Sequence; identical to SEQ ID NO: 94168
  derived and/or modified sequence opt2 from hemagglutinin__InfluenzaA__ADG21137

SEQ ID NO: 96230 - RNA, 1701 nt, Artificial Sequence; identical to SEQ ID NO: 94168
  derived and/or modified sequence opt2 from hemagglutinin__InfluenzaA__ADG21138

SEQ ID NO: 96231 - RNA, 1701 nt, Artificial Sequence; identical to SEQ ID NO: 94168
  derived and/or modified sequence opt2 from hemagglutinin__InfluenzaA__ADG21139

SEQ ID NO: 96232 - RNA, 1701 nt, Artificial Sequence
  derived and/or modified sequence opt2 from hemagglutinin__InfluenzaA__ADG21140
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucaugcucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96233 - RNA, 1701 nt, Artificial Sequence; identical to SEQ ID NO: 94168
  derived and/or modified sequence opt2 from hemagglutinin__InfluenzaA__ADG21141

SEQ ID NO: 96234 - RNA, 1701 nt, Artificial Sequence
  derived and/or modified sequence opt2 from hemagglutinin__InfluenzaA__ADG21142
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96235 - RNA, 1701 nt, Artificial Sequence; identical to SEQ ID NO: 94168
  derived and/or modified sequence opt2 from hemagglutinin__InfluenzaA__ADG21143

SEQ ID NO: 96236 - RNA, 1701 nt, Artificial Sequence; identical to SEQ ID NO: 94168
  derived and/or modified sequence opt2 from hemagglutinin__InfluenzaA__ADG21144

SEQ ID NO: 96237 - RNA, 1701 nt, Artificial Sequence
  derived and/or modified sequence opt2 from hemagglutinin__InfluenzaA__ADG21145
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaucuccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96238 - RNA, 1701 nt, Artificial Sequence; identical to SEQ ID NO: 94168
  derived and/or modified sequence opt2 from hemagglutinin__InfluenzaA__ADG21146

SEQ ID NO: 96239 - RNA, 1701 nt, Artificial Sequence; identical to SEQ ID NO: 94168
  derived and/or modified sequence opt2 from hemagglutinin__InfluenzaA__ADG21147

SEQ ID NO: 96240 - RNA, 1701 nt, Artificial Sequence; identical to SEQ ID NO: 94181
  derived and/or modified sequence opt2 from hemagglutinin__InfluenzaA__ADG21148

SEQ ID NO: 96241 - RNA, 1701 nt, Artificial Sequence; identical to SEQ ID NO: 95282
  derived and/or modified sequence opt2 from hemagglutinin__InfluenzaA__ADG21149

SEQ ID NO: 96242 - RNA, 1701 nt, Artificial Sequence; identical to SEQ ID NO: 95345
  derived and/or modified sequence opt2 from hemagglutinin__InfluenzaA__ADG21150

SEQ ID NO: 96243 - RNA, 1701 nt, Artificial Sequence; identical to SEQ ID NO: 94168
  derived and/or modified sequence opt2 from hemagglutinin__InfluenzaA__ADG21151

SEQ ID NO: 96244 - RNA, 1701 nt, Artificial Sequence; identical to SEQ ID NO: 94168
  derived and/or modified sequence opt2 from hemagglutinin__InfluenzaA__ADG21152

SEQ ID NO: 96245 - RNA, 1701 nt, Artificial Sequence; identical to SEQ ID NO: 94181
  derived and/or modified sequence opt2 from hemagglutinin__InfluenzaA__ADG21153

SEQ ID NO: 96246 - RNA, 1701 nt, Artificial Sequence; identical to SEQ ID NO: 94168
  derived and/or modified sequence opt2 from hemagglutinin__InfluenzaA__ADG21154

SEQ ID NO: 96247 - RNA, 1701 nt, Artificial Sequence; identical to SEQ ID NO: 94168
  derived and/or modified sequence opt2 from hemagglutinin__InfluenzaA__ADG21155

SEQ ID NO: 96248 - RNA, 1701 nt, Artificial Sequence; identical to SEQ ID NO: 95345
  derived and/or modified sequence opt2 from hemagglutinin__InfluenzaA__ADG21156

SEQ ID NO: 96249 - RNA, 1701 nt, Artificial Sequence; identical to SEQ ID NO: 95353
  derived and/or modified sequence opt2 from hemagglutinin__InfluenzaA__ADG21158

SEQ ID NO: 96250 - RNA, 1701 nt, Artificial Sequence
  derived and/or modified sequence opt2 from hemagglutinin__InfluenzaA__ADG21159
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 96251 - RNA, 1701 nt, Artificial Sequence; identical to SEQ ID NO: 95353
  derived and/or modified sequence opt2 from hemagglutinin__InfluenzaA__ADG21160

SEQ ID NO: 96252 - RNA, 1701 nt, Artificial Sequence
  derived and/or modified sequence opt2 from hemagglutinin__InfluenzaA__ADG21161
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacaacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96253 - RNA, 1701 nt, Artificial Sequence
  derived and/or modified sequence opt2 from hemagglutinin__InfluenzaA__ADG21163
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96254 - RNA, 1701 nt, Artificial Sequence
  derived and/or modified sequence opt2 from hemagglutinin__InfluenzaA__ADG21165
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96255 - RNA, 1701 nt, Artificial Sequence; identical to SEQ ID NO: 94168
  derived and/or modified sequence opt2 from hemagglutinin__InfluenzaA__ADG21166

SEQ ID NO: 96256 - RNA, 1701 nt, Artificial Sequence
  derived and/or modified sequence opt2 from hemagglutinin__InfluenzaA__ADG21168
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguucuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96257 - RNA, 1701 nt, Artificial Sequence; identical to SEQ ID NO: 96210
  derived and/or modified sequence opt2 from hemagglutinin__InfluenzaA__ADG21169

SEQ ID NO: 96258 - RNA, 1701 nt, Artificial Sequence; identical to SEQ ID NO: 94168
  derived and/or modified sequence opt2 from hemagglutinin__InfluenzaA__ADG21170

SEQ ID NO: 96259 - RNA, 1701 nt, Artificial Sequence; identical to SEQ ID NO: 94168
  derived and/or modified sequence opt2 from hemagglutinin__InfluenzaA__ADG21173

SEQ ID NO: 96260 - RNA, 1701 nt, Artificial Sequence; identical to SEQ ID NO: 94181
  derived and/or modified sequence opt2 from hemagglutinin__InfluenzaA__ADG21174

SEQ ID NO: 96261 - RNA, 1701 nt, Artificial Sequence; identical to SEQ ID NO: 94181
  derived and/or modified sequence opt2 from hemagglutinin__InfluenzaA__ADG21175

SEQ ID NO: 96262 - RNA, 1701 nt, Artificial Sequence; identical to SEQ ID NO: 94168
  derived and/or modified sequence opt2 from hemagglutinin__InfluenzaA__ADG21176

SEQ ID NO: 96263 - RNA, 1701 nt, Artificial Sequence; identical to SEQ ID NO: 94168
  derived and/or modified sequence opt2 from hemagglutinin__InfluenzaA__ADG21177

SEQ ID NO: 96264 - RNA, 1701 nt, Artificial Sequence; identical to SEQ ID NO: 94168
  derived and/or modified sequence opt2 from hemagglutinin__InfluenzaA__ADG21178

SEQ ID NO: 96265 - RNA, 1701 nt, Artificial Sequence; identical to SEQ ID NO: 94534
  derived and/or modified sequence opt2 from hemagglutinin__InfluenzaA__ADG21179

SEQ ID NO: 96266 - RNA, 1701 nt, Artificial Sequence; identical to SEQ ID NO: 94168
  derived and/or modified sequence opt2 from hemagglutinin__InfluenzaA__ADG21180

SEQ ID NO: 96267 - RNA, 1701 nt, Artificial Sequence; identical to SEQ ID NO: 94168
  derived and/or modified sequence opt2 from hemagglutinin__InfluenzaA__ADG21181

SEQ ID NO: 96268 - RNA, 1701 nt, Artificial Sequence; identical to SEQ ID NO: 94168
  derived and/or modified sequence opt2 from hemagglutinin__InfluenzaA__ADG21182

SEQ ID NO: 96269 - RNA, 1701 nt, Artificial Sequence; identical to SEQ ID NO: 94168
  derived and/or modified sequence opt2 from hemagglutinin__InfluenzaA__ADG21183

SEQ ID NO: 96270 - RNA, 1701 nt, Artificial Sequence; identical to SEQ ID NO: 95345
  derived and/or modified sequence opt2 from hemagglutinin__InfluenzaA__ADG21184

SEQ ID NO: 96271 - RNA, 1701 nt, Artificial Sequence
  derived and/or modified sequence opt2 from hemagglutinin__InfluenzaA__ADG21185
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96272 - RNA, 1701 nt, Artificial Sequence; identical to SEQ ID NO: 95527
  derived and/or modified sequence opt2 from hemagglutinin__InfluenzaA__ADG21188

SEQ ID NO: 96273 - RNA, 1707 nt, Artificial Sequence
  derived and/or modified sequence opt2 from hemagglutinin__InfluenzaA__ADG21402
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucauccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96274 - RNA, 1704 nt, Artificial Sequence
  derived and/or modified sequence opt2 from hemagglutinin__InfluenzaA__ADG21414
auggagaagaucguccuccuccucgccaucgucuccaucgucaaguccgaccagaucugcaucggcuaccacgccaacaacuccaccgagcacgucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacggcgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96275 - RNA, 1704 nt, Artificial Sequence
  derived and/or modified sequence opt2 from hemagglutinin__InfluenzaA__ADG21416
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgccgccgagcagaccggccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgucaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96276 - RNA, 1704 nt, Artificial Sequence
  derived and/or modified sequence opt2 from hemagglutinin__InfluenzaA__ADG21420
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96277 - RNA, 1704 nt, Artificial Sequence
  derived and/or modified sequence opt2 from hemagglutinin__InfluenzaA__ADG21422
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccaccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgcuccaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96278 - RNA, 1704 nt, Artificial Sequence
  derived and/or modified sequence opt2 from hemagglutinin__InfluenzaA__ADG21425
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacggcgccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgccgaggagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacgacaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccagggcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacgcccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 96279 - RNA, 1704 nt, Artificial Sequence
  derived and/or modified sequence opt2 from hemagglutinin__InfluenzaA__ADG21429
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucgagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgucaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccgaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccuccuccucuggaugugcuccaacggcucccuccagugccgcaucugcaucuga

SEQ ID NO: 96280 - RNA, 1704 nt, Artificial Sequence
  derived and/or modified sequence opt2 from hemagglutinin__InfluenzaA__ADG21437
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucacccagaagaacaacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgucaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96281 - RNA, 1704 nt, Artificial Sequence
  derived and/or modified sequence opt2 from hemagglutinin__InfluenzaA__ADG21439
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaagggcuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucgucccccagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96282 - RNA, 1704 nt, Artificial Sequence
  derived and/or modified sequence opt2 from hemagglutinin__InfluenzaA__ADG21441
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccuccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgaggccgagcagaccucccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96283 - RNA, 1704 nt, Artificial Sequence
  derived and/or modified sequence opt2 from hemagglutinin__InfluenzaA__ADG21443
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccaccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96284 - RNA, 1704 nt, Artificial Sequence
  derived and/or modified sequence opt2 from hemagglutinin__InfluenzaA__ADG21445
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccuccaacgaccucugcuaccccggcaacuucaacgacuacgaggagcucaagcaccuccucucccgcaucaaccacuucgagaagauccagaucauccccaagaacuccugguccgaccacgaggccuccggcgucuccuccgccugccccuaccagggccgcuccuccuucuuccgcaacgucgucuggcucaccaagaagaacaacgccuaccccaccaucaagaaguccuacaacaacaccaaccaggaggaccuccucguccucuggggcauccaccaccccaacgacgaggccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 96285 - RNA, 1701 nt, Artificial Sequence; identical to SEQ ID NO: 94423
  derived and/or modified sequence opt2 from hemagglutinin__InfluenzaA__ADG21912

SEQ ID NO: 96286 - RNA, 1701 nt, Artificial Sequence; identical to SEQ ID NO: 94181
  derived and/or modified sequence opt2 from hemagglutinin__InfluenzaA__ADG21913

SEQ ID NO: 96287 - RNA, 1701 nt, Artificial Sequence
  derived and/or modified sequence opt2 from hemagglutinin__InfluenzaA__ADG21914
augaaggccaucaucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96288 - RNA, 1701 nt, Artificial Sequence
  derived and/or modified sequence opt2 from hemagglutinin__InfluenzaA__ADG21915
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaucgagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96289 - RNA, 1701 nt, Artificial Sequence; identical to SEQ ID NO: 94423
  derived and/or modified sequence opt2 from hemagglutinin__InfluenzaA__ADG21916

SEQ ID NO: 96290 - RNA, 1701 nt, Artificial Sequence; identical to SEQ ID NO: 94181
  derived and/or modified sequence opt2 from hemagglutinin__InfluenzaA__ADG21917

SEQ ID NO: 96291 - RNA, 1701 nt, Artificial Sequence; identical to SEQ ID NO: 95681
  derived and/or modified sequence opt2 from hemagglutinin__InfluenzaA__ADG21918

SEQ ID NO: 96292 - RNA, 1701 nt, Artificial Sequence
  derived and/or modified sequence opt2 from hemagglutinin__InfluenzaA__ADG21919
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96293 - RNA, 1701 nt, Artificial Sequence; identical to SEQ ID NO: 94423
  derived and/or modified sequence opt2 from hemagglutinin__InfluenzaA__ADG21921

SEQ ID NO: 96294 - RNA, 1701 nt, Artificial Sequence; identical to SEQ ID NO: 94181
  derived and/or modified sequence opt2 from hemagglutinin__InfluenzaA__ADG21922

SEQ ID NO: 96295 - RNA, 1701 nt, Artificial Sequence
  derived and/or modified sequence opt2 from hemagglutinin__InfluenzaA__ADG21923
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96296 - RNA, 1701 nt, Artificial Sequence
  derived and/or modified sequence opt2 from hemagglutinin__InfluenzaA__ADG21924
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagaacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96297 - RNA, 1701 nt, Artificial Sequence
  derived and/or modified sequence opt2 from hemagglutinin__InfluenzaA__ADG21925
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96298 - RNA, 1701 nt, Artificial Sequence
  derived and/or modified sequence opt2 from hemagglutinin__InfluenzaA__ADG21926
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcaaccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96299 - RNA, 1701 nt, Artificial Sequence; identical to SEQ ID NO: 94423
  derived and/or modified sequence opt2 from hemagglutinin__InfluenzaA__ADG21927

SEQ ID NO: 96300 - RNA, 1701 nt, Artificial Sequence
  derived and/or modified sequence opt2 from hemagglutinin__InfluenzaA__ADG21928
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgcccccgcguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96301 - RNA, 1701 nt, Artificial Sequence; identical to SEQ ID NO: 96297
  derived and/or modified sequence opt2 from hemagglutinin__InfluenzaA__ADG21930

SEQ ID NO: 96302 - RNA, 1701 nt, Artificial Sequence; identical to SEQ ID NO: 94423
  derived and/or modified sequence opt2 from hemagglutinin__InfluenzaA__ADG21931

SEQ ID NO: 96303 - RNA, 1701 nt, Artificial Sequence; identical to SEQ ID NO: 94423
  derived and/or modified sequence opt2 from hemagglutinin__InfluenzaA__ADG21932

SEQ ID NO: 96304 - RNA, 1701 nt, Artificial Sequence; identical to SEQ ID NO: 94423
  derived and/or modified sequence opt2 from hemagglutinin__InfluenzaA__ADG21933

SEQ ID NO: 96305 - RNA, 1701 nt, Artificial Sequence; identical to SEQ ID NO: 96297
  derived and/or modified sequence opt2 from hemagglutinin__InfluenzaA__ADG21934

SEQ ID NO: 96306 - RNA, 1701 nt, Artificial Sequence
  derived and/or modified sequence opt2 from hemagglutinin__InfluenzaA__ADG21935
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaacugccagacccccaacggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96307 - RNA, 1701 nt, Artificial Sequence; identical to SEQ ID NO: 94423
  derived and/or modified sequence opt2 from hemagglutinin__InfluenzaA__ADG21936

SEQ ID NO: 96308 - RNA, 1701 nt, Artificial Sequence; identical to SEQ ID NO: 94423
  derived and/or modified sequence opt2 from hemagglutinin__InfluenzaA__ADG21937

SEQ ID NO: 96309 - RNA, 1701 nt, Artificial Sequence
  derived and/or modified sequence opt2 from hemagglutinin__InfluenzaA__ADG21938
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcaaccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96310 - RNA, 1701 nt, Artificial Sequence; identical to SEQ ID NO: 94423
  derived and/or modified sequence opt2 from hemagglutinin__InfluenzaA__ADG21939

SEQ ID NO: 96311 - RNA, 1701 nt, Artificial Sequence; identical to SEQ ID NO: 94423
  derived and/or modified sequence opt2 from hemagglutinin__InfluenzaA__ADG21940

SEQ ID NO: 96312 - RNA, 1701 nt, Artificial Sequence
  derived and/or modified sequence opt2 from hemagglutinin__InfluenzaA__ADG21941
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96313 - RNA, 1701 nt, Artificial Sequence
  derived and/or modified sequence opt2 from hemagglutinin__InfluenzaA__ADG21943
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96314 - RNA, 1701 nt, Artificial Sequence
  derived and/or modified sequence opt2 from hemagglutinin__InfluenzaA__ADG21944
auggaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96315 - RNA, 1701 nt, Artificial Sequence; identical to SEQ ID NO: 94423
  derived and/or modified sequence opt2 from hemagglutinin__InfluenzaA__ADG21945

SEQ ID NO: 96316 - RNA, 1701 nt, Artificial Sequence; identical to SEQ ID NO: 94423
  derived and/or modified sequence opt2 from hemagglutinin__InfluenzaA__ADG21946

SEQ ID NO: 96317 - RNA, 1701 nt, Artificial Sequence; identical to SEQ ID NO: 94423
  derived and/or modified sequence opt2 from hemagglutinin__InfluenzaA__ADG21947

SEQ ID NO: 96318 - RNA, 1701 nt, Artificial Sequence
  derived and/or modified sequence opt2 from hemagglutinin__InfluenzaA__ADG21948
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgaccaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96319 - RNA, 1701 nt, Artificial Sequence
  derived and/or modified sequence opt2 from hemagglutinin__InfluenzaA__ADG27794
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaccuaccagauccucgccaucuacuccaccgucgccuccucccucguccucgucgucucccucggcgccaucuccuucuggaugugcuccaacggcucccuccagugccgcaucugcaucuga

SEQ ID NO: 96320 - RNA, 1701 nt, Artificial Sequence; identical to SEQ ID NO: 94168
  derived and/or modified sequence opt2 from hemagglutinin__InfluenzaA__ADG27948

SEQ ID NO: 96321 - RNA, 1701 nt, Artificial Sequence; identical to SEQ ID NO: 94168
  derived and/or modified sequence opt2 from hemagglutinin__InfluenzaA__ADG27966

SEQ ID NO: 96322 - RNA, 1701 nt, Artificial Sequence
  derived and/or modified sequence opt2 from hemagglutinin__InfluenzaA__ADG27974
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 96323 - RNA, 1701 nt, Artificial Sequence
  derived and/or modified sequence opt2 from hemagglutinin__InfluenzaA__ADG27982
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96324 - RNA, 1701 nt, Artificial Sequence; identical to SEQ ID NO: 94168
  derived and/or modified sequence opt2 from hemagglutinin__InfluenzaA__ADG27988

SEQ ID NO: 96325 - RNA, 1701 nt, Artificial Sequence; identical to SEQ ID NO: 94168
  derived and/or modified sequence opt2 from hemagglutinin__InfluenzaA__ADG27997

SEQ ID NO: 96326 - RNA, 1701 nt, Artificial Sequence; identical to SEQ ID NO: 94168
  derived and/or modified sequence opt2 from hemagglutinin__InfluenzaA__ADG28011

SEQ ID NO: 96327 - RNA, 1701 nt, Artificial Sequence; identical to SEQ ID NO: 95733
  derived and/or modified sequence opt2 from hemagglutinin__InfluenzaA__ADG42093

SEQ ID NO: 96328 - RNA, 1701 nt, Artificial Sequence; identical to SEQ ID NO: 95345
  derived and/or modified sequence opt2 from hemagglutinin__InfluenzaA__ADG42103

SEQ ID NO: 96329 - RNA, 1701 nt, Artificial Sequence; identical to SEQ ID NO: 94534
  derived and/or modified sequence opt2 from hemagglutinin__InfluenzaA__ADG42113

SEQ ID NO: 96330 - RNA, 1701 nt, Artificial Sequence; identical to SEQ ID NO: 95733
  derived and/or modified sequence opt2 from hemagglutinin__InfluenzaA__ADG42123

SEQ ID NO: 96331 - RNA, 1701 nt, Artificial Sequence
  derived and/or modified sequence opt2 from hemagglutinin__InfluenzaA__ADG42133
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccuacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgucaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96332 - RNA, 1701 nt, Artificial Sequence
  derived and/or modified sequence opt2 from hemagglutinin__InfluenzaA__ADG42143
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 96333 - RNA, 1701 nt, Artificial Sequence
  derived and/or modified sequence opt2 from hemagglutinin__InfluenzaA__ADG42153
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccucgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96334 - RNA, 1701 nt, Artificial Sequence; identical to SEQ ID NO: 94181
  derived and/or modified sequence opt2 from hemagglutinin__InfluenzaA__ADG42193

SEQ ID NO: 96335 - RNA, 1701 nt, Artificial Sequence; identical to SEQ ID NO: 94181
  derived and/or modified sequence opt2 from hemagglutinin__InfluenzaA__ADG42213

SEQ ID NO: 96336 - RNA, 1701 nt, Artificial Sequence; identical to SEQ ID NO: 94181
  derived and/or modified sequence opt2 from hemagglutinin__InfluenzaA__ADG42233

SEQ ID NO: 96337 - RNA, 1701 nt, Artificial Sequence
  derived and/or modified sequence opt2 from hemagglutinin__InfluenzaA__ADG42243
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccucgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96338 - RNA, 1701 nt, Artificial Sequence; identical to SEQ ID NO: 95601
  derived and/or modified sequence opt2 from hemagglutinin__InfluenzaA__ADG42253

SEQ ID NO: 96339 - RNA, 1701 nt, Artificial Sequence; identical to SEQ ID NO: 94181
  derived and/or modified sequence opt2 from hemagglutinin__InfluenzaA__ADG42263

SEQ ID NO: 96340 - RNA, 1701 nt, Artificial Sequence; identical to SEQ ID NO: 95282
  derived and/or modified sequence opt2 from hemagglutinin__InfluenzaA__ADG42273

SEQ ID NO: 96341 - RNA, 1701 nt, Artificial Sequence; identical to SEQ ID NO: 95282
  derived and/or modified sequence opt2 from hemagglutinin__InfluenzaA__ADG42283

SEQ ID NO: 96342 - RNA, 1701 nt, Artificial Sequence; identical to SEQ ID NO: 95864
  derived and/or modified sequence opt2 from hemagglutinin__InfluenzaA__ADG42293

SEQ ID NO: 96343 - RNA, 1701 nt, Artificial Sequence
  derived and/or modified sequence opt2 from hemagglutinin__InfluenzaA__ADG42303
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96344 - RNA, 1701 nt, Artificial Sequence; identical to SEQ ID NO: 95891
  derived and/or modified sequence opt2 from hemagglutinin__InfluenzaA__ADG42313

SEQ ID NO: 96345 - RNA, 1701 nt, Artificial Sequence
  derived and/or modified sequence opt2 from hemagglutinin__InfluenzaA__ADG42323
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96346 - RNA, 1701 nt, Artificial Sequence
  derived and/or modified sequence opt2 from hemagglutinin__InfluenzaA__ADG42333
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96347 - RNA, 1701 nt, Artificial Sequence
  derived and/or modified sequence opt2 from hemagglutinin__InfluenzaA__ADG42343
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggaguccaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96348 - RNA, 1701 nt, Artificial Sequence
  derived and/or modified sequence opt2 from hemagglutinin__InfluenzaA__ADG42363
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96349 - RNA, 1701 nt, Artificial Sequence
  derived and/or modified sequence opt2 from hemagglutinin__InfluenzaA__ADG42373
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96350 - RNA, 1701 nt, Artificial Sequence
  derived and/or modified sequence opt2 from hemagglutinin__InfluenzaA__ADG42393
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 96351 - RNA, 1701 nt, Artificial Sequence; identical to SEQ ID NO: 95345
  derived and/or modified sequence opt2 from hemagglutinin__InfluenzaA__ADG42403

SEQ ID NO: 96352 - RNA, 1701 nt, Artificial Sequence; identical to SEQ ID NO: 95601
  derived and/or modified sequence opt2 from hemagglutinin__InfluenzaA__ADG42413

SEQ ID NO: 96353 - RNA, 1701 nt, Artificial Sequence; identical to SEQ ID NO: 96348
  derived and/or modified sequence opt2 from hemagglutinin__InfluenzaA__ADG42423

SEQ ID NO: 96354 - RNA, 1701 nt, Artificial Sequence; identical to SEQ ID NO: 95601
  derived and/or modified sequence opt2 from hemagglutinin__InfluenzaA__ADG42443

SEQ ID NO: 96355 - RNA, 1701 nt, Artificial Sequence
  derived and/or modified sequence opt2 from hemagglutinin__InfluenzaA__ADG42453
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcgucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96356 - RNA, 1701 nt, Artificial Sequence; identical to SEQ ID NO: 94534
  derived and/or modified sequence opt2 from hemagglutinin__InfluenzaA__ADG42463

SEQ ID NO: 96357 - RNA, 1701 nt, Artificial Sequence; identical to SEQ ID NO: 94181
  derived and/or modified sequence opt2 from hemagglutinin__InfluenzaA__ADG42473

SEQ ID NO: 96358 - RNA, 1701 nt, Artificial Sequence; identical to SEQ ID NO: 95601
  derived and/or modified sequence opt2 from hemagglutinin__InfluenzaA__ADG42483

SEQ ID NO: 96359 - RNA, 1701 nt, Artificial Sequence; identical to SEQ ID NO: 95733
  derived and/or modified sequence opt2 from hemagglutinin__InfluenzaA__ADG42493

SEQ ID NO: 96360 - RNA, 1701 nt, Artificial Sequence; identical to SEQ ID NO: 95794
  derived and/or modified sequence opt2 from hemagglutinin__InfluenzaA__ADG42503

SEQ ID NO: 96361 - RNA, 1701 nt, Artificial Sequence; identical to SEQ ID NO: 95282
  derived and/or modified sequence opt2 from hemagglutinin__InfluenzaA__ADG42513

SEQ ID NO: 96362 - RNA, 1701 nt, Artificial Sequence
  derived and/or modified sequence opt2 from hemagglutinin__InfluenzaA__ADG42533
augaaggccauccucgucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96363 - RNA, 1701 nt, Artificial Sequence
  derived and/or modified sequence opt2 from hemagglutinin__InfluenzaA__ADG42553
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96364 - RNA, 1701 nt, Artificial Sequence
  derived and/or modified sequence opt2 from hemagglutinin__InfluenzaA__ADG42573
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96365 - RNA, 1701 nt, Artificial Sequence
  derived and/or modified sequence opt2 from hemagglutinin__InfluenzaA__ADG42583
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96366 - RNA, 1701 nt, Artificial Sequence; identical to SEQ ID NO: 95778
  derived and/or modified sequence opt2 from hemagglutinin__InfluenzaA__ADG42593

SEQ ID NO: 96367 - RNA, 1701 nt, Artificial Sequence
  derived and/or modified sequence opt2 from hemagglutinin__InfluenzaA__ADG42603
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgcaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcuccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96368 - RNA, 1701 nt, Artificial Sequence
  derived and/or modified sequence opt2 from hemagglutinin__InfluenzaA__ADG42613
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96369 - RNA, 1701 nt, Artificial Sequence; identical to SEQ ID NO: 95808
  derived and/or modified sequence opt2 from hemagglutinin__InfluenzaA__ADG42623

SEQ ID NO: 96370 - RNA, 1701 nt, Artificial Sequence; identical to SEQ ID NO: 94181
  derived and/or modified sequence opt2 from hemagglutinin__InfluenzaA__ADG42633

SEQ ID NO: 96371 - RNA, 1701 nt, Artificial Sequence
  derived and/or modified sequence opt2 from hemagglutinin__InfluenzaA__ADG42643
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgccgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacgucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96372 - RNA, 1701 nt, Artificial Sequence
  derived and/or modified sequence opt2 from hemagglutinin__InfluenzaA__ADG42653
augaaggccauccucgucguccuccucuacaccuccgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96373 - RNA, 1701 nt, Artificial Sequence; identical to SEQ ID NO: 95345
  derived and/or modified sequence opt2 from hemagglutinin__InfluenzaA__ADG42663

SEQ ID NO: 96374 - RNA, 1701 nt, Artificial Sequence
  derived and/or modified sequence opt2 from hemagglutinin__InfluenzaA__ADG42673
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccggcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96375 - RNA, 1701 nt, Artificial Sequence
  derived and/or modified sequence opt2 from hemagglutinin__InfluenzaA__ADG42683
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96376 - RNA, 1701 nt, Artificial Sequence; identical to SEQ ID NO: 95345
  derived and/or modified sequence opt2 from hemagglutinin__InfluenzaA__ADG42693

SEQ ID NO: 96377 - RNA, 1701 nt, Artificial Sequence; identical to SEQ ID NO: 96053
  derived and/or modified sequence opt2 from hemagglutinin__InfluenzaA__ADG42703

SEQ ID NO: 96378 - RNA, 1701 nt, Artificial Sequence
  derived and/or modified sequence opt2 from hemagglutinin__InfluenzaA__ADG42723
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagauggccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96379 - RNA, 1701 nt, Artificial Sequence; identical to SEQ ID NO: 95808
  derived and/or modified sequence opt2 from hemagglutinin__InfluenzaA__ADG42743

SEQ ID NO: 96380 - RNA, 1701 nt, Artificial Sequence
  derived and/or modified sequence opt2 from hemagglutinin__InfluenzaA__ADG42753
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacuccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96381 - RNA, 1701 nt, Artificial Sequence; identical to SEQ ID NO: 95345
  derived and/or modified sequence opt2 from hemagglutinin__InfluenzaA__ADG42763

SEQ ID NO: 96382 - RNA, 1701 nt, Artificial Sequence; identical to SEQ ID NO: 95345
  derived and/or modified sequence opt2 from hemagglutinin__InfluenzaA__ADG42773

SEQ ID NO: 96383 - RNA, 1701 nt, Artificial Sequence
  derived and/or modified sequence opt2 from hemagglutinin__InfluenzaA__ADG42783
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96384 - RNA, 1701 nt, Artificial Sequence; identical to SEQ ID NO: 95345
  derived and/or modified sequence opt2 from hemagglutinin__InfluenzaA__ADG42793

SEQ ID NO: 96385 - RNA, 1701 nt, Artificial Sequence; identical to SEQ ID NO: 96383
  derived and/or modified sequence opt2 from hemagglutinin__InfluenzaA__ADG42803

SEQ ID NO: 96386 - RNA, 1701 nt, Artificial Sequence; identical to SEQ ID NO: 95733
  derived and/or modified sequence opt2 from hemagglutinin__InfluenzaA__ADG42813

SEQ ID NO: 96387 - RNA, 1701 nt, Artificial Sequence; identical to SEQ ID NO: 95876
  derived and/or modified sequence opt2 from hemagglutinin__InfluenzaA__ADG42823

SEQ ID NO: 96388 - RNA, 1701 nt, Artificial Sequence; identical to SEQ ID NO: 95778
  derived and/or modified sequence opt2 from hemagglutinin__InfluenzaA__ADG42833

SEQ ID NO: 96389 - RNA, 1701 nt, Artificial Sequence; identical to SEQ ID NO: 95345
  derived and/or modified sequence opt2 from hemagglutinin__InfluenzaA__ADG42843

SEQ ID NO: 96390 - RNA, 1701 nt, Artificial Sequence; identical to SEQ ID NO: 95345
  derived and/or modified sequence opt2 from hemagglutinin__InfluenzaA__ADG42853

SEQ ID NO: 96391 - RNA, 1701 nt, Artificial Sequence; identical to SEQ ID NO: 95899
  derived and/or modified sequence opt2 from hemagglutinin__InfluenzaA__ADG42863

SEQ ID NO: 96392 - RNA, 1701 nt, Artificial Sequence; identical to SEQ ID NO: 95919
  derived and/or modified sequence opt2 from hemagglutinin__InfluenzaA__ADG42883

SEQ ID NO: 96393 - RNA, 1701 nt, Artificial Sequence
  derived and/or modified sequence opt2 from hemagglutinin__InfluenzaA__ADG42893
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaaccuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96394 - RNA, 1701 nt, Artificial Sequence; identical to SEQ ID NO: 94181
  derived and/or modified sequence opt2 from hemagglutinin__InfluenzaA__ADG42903

SEQ ID NO: 96395 - RNA, 1701 nt, Artificial Sequence; identical to SEQ ID NO: 95345
  derived and/or modified sequence opt2 from hemagglutinin__InfluenzaA__ADG42913

SEQ ID NO: 96396 - RNA, 1701 nt, Artificial Sequence; identical to SEQ ID NO: 95909
  derived and/or modified sequence opt2 from hemagglutinin__InfluenzaA__ADG42923

SEQ ID NO: 96397 - RNA, 1701 nt, Artificial Sequence
  derived and/or modified sequence opt2 from hemagglutinin__InfluenzaA__ADG57087
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccaucucccucguccucgucgucucccucggcgccaucuccuucuggaugugcuccaacggcucccuccgcugccgcaucugcaucuga

SEQ ID NO: 96398 - RNA, 1701 nt, Artificial Sequence; identical to SEQ ID NO: 94181
  derived and/or modified sequence opt2 from hemagglutinin__InfluenzaA__ADG57088

SEQ ID NO: 96399 - RNA, 1701 nt, Artificial Sequence
  derived and/or modified sequence opt2 from hemagglutinin__InfluenzaA__ADG57089
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucauccaguacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccgaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96400 - RNA, 1701 nt, Artificial Sequence
  derived and/or modified sequence opt2 from hemagglutinin__InfluenzaA__ADG57090
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgcccagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96401 - RNA, 1701 nt, Artificial Sequence
  derived and/or modified sequence opt2 from hemagglutinin__InfluenzaA__ADG57091
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagcgcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96402 - RNA, 1701 nt, Artificial Sequence
  derived and/or modified sequence opt2 from hemagglutinin__InfluenzaA__ADG57092
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaucaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96403 - RNA, 1701 nt, Artificial Sequence
  derived and/or modified sequence opt2 from hemagglutinin__InfluenzaA__ADG57093
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucugguccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96404 - RNA, 1701 nt, Artificial Sequence
  derived and/or modified sequence opt2 from hemagglutinin__InfluenzaA__ADG57094
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96405 - RNA, 1701 nt, Artificial Sequence; identical to SEQ ID NO: 94181
  derived and/or modified sequence opt2 from hemagglutinin__InfluenzaA__ADG57095

SEQ ID NO: 96406 - RNA, 1701 nt, Artificial Sequence
  derived and/or modified sequence opt2 from hemagglutinin__InfluenzaA__ADG57097
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96407 - RNA, 1701 nt, Artificial Sequence; identical to SEQ ID NO: 95345
  derived and/or modified sequence opt2 from hemagglutinin__InfluenzaA__ADG57098

SEQ ID NO: 96408 - RNA, 1701 nt, Artificial Sequence
  derived and/or modified sequence opt2 from hemagglutinin__InfluenzaA__ADG57099
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucaccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96409 - RNA, 1701 nt, Artificial Sequence
  derived and/or modified sequence opt2 from hemagglutinin__InfluenzaA__ADG57100
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccggcggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96410 - RNA, 1701 nt, Artificial Sequence; identical to SEQ ID NO: 94181
  derived and/or modified sequence opt2 from hemagglutinin__InfluenzaA__ADG58939

SEQ ID NO: 96411 - RNA, 1701 nt, Artificial Sequence; identical to SEQ ID NO: 94181
  derived and/or modified sequence opt2 from hemagglutinin__InfluenzaA__ADG58940

SEQ ID NO: 96412 - RNA, 1701 nt, Artificial Sequence
  derived and/or modified sequence opt2 from hemagglutinin__InfluenzaA__ADG58941
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccacgagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96413 - RNA, 1701 nt, Artificial Sequence
  derived and/or modified sequence opt2 from hemagglutinin__InfluenzaA__ADG58942
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccuccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96414 - RNA, 1701 nt, Artificial Sequence; identical to SEQ ID NO: 94181
  derived and/or modified sequence opt2 from hemagglutinin__InfluenzaA__ADG58943

SEQ ID NO: 96415 - RNA, 1701 nt, Artificial Sequence
  derived and/or modified sequence opt2 from hemagglutinin__InfluenzaA__ADG58944
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96416 - RNA, 1701 nt, Artificial Sequence; identical to SEQ ID NO: 94979
  derived and/or modified sequence opt2 from hemagglutinin__InfluenzaA__ADG58946

SEQ ID NO: 96417 - RNA, 1701 nt, Artificial Sequence; identical to SEQ ID NO: 94181
  derived and/or modified sequence opt2 from hemagglutinin__InfluenzaA__ADG58947

SEQ ID NO: 96418 - RNA, 1701 nt, Artificial Sequence
  derived and/or modified sequence opt2 from hemagglutinin__InfluenzaA__ADG58948
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96419 - RNA, 1701 nt, Artificial Sequence
  derived and/or modified sequence opt2 from hemagglutinin__InfluenzaA__ADG58949
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96420 - RNA, 1701 nt, Artificial Sequence
  derived and/or modified sequence opt2 from hemagglutinin__InfluenzaA__ADG58951
augaaggccauccucgucguccuccuccacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccggcaacggcaccugcuaccccggcgaguucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcaucgaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96421 - RNA, 1701 nt, Artificial Sequence; identical to SEQ ID NO: 96420
  derived and/or modified sequence opt2 from hemagglutinin__InfluenzaA__ADG58952

SEQ ID NO: 96422 - RNA, 1701 nt, Artificial Sequence; identical to SEQ ID NO: 96420
  derived and/or modified sequence opt2 from hemagglutinin__InfluenzaA__ADG58953

SEQ ID NO: 96423 - RNA, 1701 nt, Artificial Sequence; identical to SEQ ID NO: 96420
  derived and/or modified sequence opt2 from hemagglutinin__InfluenzaA__ADG58954

SEQ ID NO: 96424 - RNA, 1701 nt, Artificial Sequence; identical to SEQ ID NO: 96420
  derived and/or modified sequence opt2 from hemagglutinin__InfluenzaA__ADG58955

SEQ ID NO: 96425 - RNA, 1701 nt, Artificial Sequence; identical to SEQ ID NO: 96420
  derived and/or modified sequence opt2 from hemagglutinin__InfluenzaA__ADG58956

SEQ ID NO: 96426 - RNA, 1701 nt, Artificial Sequence
  derived and/or modified sequence opt2 from hemagglutinin__InfluenzaA__ADG58957
augaaggccauccucgucguccuccuccacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccggcaacggcaccugcuaccccggcgaguucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96427 - RNA, 1701 nt, Artificial Sequence
  derived and/or modified sequence opt2 from hemagglutinin__InfluenzaA__ADG58959
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96428 - RNA, 1701 nt, Artificial Sequence; identical to SEQ ID NO: 96345
  derived and/or modified sequence opt2 from hemagglutinin__InfluenzaA__ADG58960

SEQ ID NO: 96429 - RNA, 1701 nt, Artificial Sequence; identical to SEQ ID NO: 96345
  derived and/or modified sequence opt2 from hemagglutinin__InfluenzaA__ADG58961

SEQ ID NO: 96430 - RNA, 1701 nt, Artificial Sequence; identical to SEQ ID NO: 96345
  derived and/or modified sequence opt2 from hemagglutinin__InfluenzaA__ADG58962

SEQ ID NO: 96431 - RNA, 1701 nt, Artificial Sequence; identical to SEQ ID NO: 96345
  derived and/or modified sequence opt2 from hemagglutinin__InfluenzaA__ADG58963

SEQ ID NO: 96432 - RNA, 1701 nt, Artificial Sequence; identical to SEQ ID NO: 96345
  derived and/or modified sequence opt2 from hemagglutinin__InfluenzaA__ADG58964

SEQ ID NO: 96433 - RNA, 1701 nt, Artificial Sequence; identical to SEQ ID NO: 96345
  derived and/or modified sequence opt2 from hemagglutinin__InfluenzaA__ADG58965

SEQ ID NO: 96434 - RNA, 1701 nt, Artificial Sequence; identical to SEQ ID NO: 96345
  derived and/or modified sequence opt2 from hemagglutinin__InfluenzaA__ADG58966

SEQ ID NO: 96435 - RNA, 1701 nt, Artificial Sequence; identical to SEQ ID NO: 96345
  derived and/or modified sequence opt2 from hemagglutinin__InfluenzaA__ADG58967

SEQ ID NO: 96436 - RNA, 1701 nt, Artificial Sequence; identical to SEQ ID NO: 96345
  derived and/or modified sequence opt2 from hemagglutinin__InfluenzaA__ADG58968

SEQ ID NO: 96437 - RNA, 1701 nt, Artificial Sequence; identical to SEQ ID NO: 94181
  derived and/or modified sequence opt2 from hemagglutinin__InfluenzaA__ADG59628

SEQ ID NO: 96438 - RNA, 1701 nt, Artificial Sequence; identical to SEQ ID NO: 94181
  derived and/or modified sequence opt2 from hemagglutinin__InfluenzaA__ADG59629

SEQ ID NO: 96439 - RNA, 1701 nt, Artificial Sequence; identical to SEQ ID NO: 94181
  derived and/or modified sequence opt2 from hemagglutinin__InfluenzaA__ADG59630

SEQ ID NO: 96440 - RNA, 1701 nt, Artificial Sequence; identical to SEQ ID NO: 94181
  derived and/or modified sequence opt2 from hemagglutinin__InfluenzaA__ADG59631

SEQ ID NO: 96441 - RNA, 1701 nt, Artificial Sequence; identical to SEQ ID NO: 94181
  derived and/or modified sequence opt2 from hemagglutinin__InfluenzaA__ADG59632

SEQ ID NO: 96442 - RNA, 1701 nt, Artificial Sequence; identical to SEQ ID NO: 95282
  derived and/or modified sequence opt2 from hemagglutinin__InfluenzaA__ADG59633

SEQ ID NO: 96443 - RNA, 1701 nt, Artificial Sequence; identical to SEQ ID NO: 95282
  derived and/or modified sequence opt2 from hemagglutinin__InfluenzaA__ADG59634

SEQ ID NO: 96444 - RNA, 1701 nt, Artificial Sequence; identical to SEQ ID NO: 94181
  derived and/or modified sequence opt2 from hemagglutinin__InfluenzaA__ADG59635

SEQ ID NO: 96445 - RNA, 1701 nt, Artificial Sequence
  derived and/or modified sequence opt2 from hemagglutinin__InfluenzaA__ADG59636
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96446 - RNA, 1701 nt, Artificial Sequence; identical to SEQ ID NO: 94929
  derived and/or modified sequence opt2 from hemagglutinin__InfluenzaA__ADG59638

SEQ ID NO: 96447 - RNA, 1701 nt, Artificial Sequence; identical to SEQ ID NO: 95282
  derived and/or modified sequence opt2 from hemagglutinin__InfluenzaA__ADG59639

SEQ ID NO: 96448 - RNA, 1701 nt, Artificial Sequence; identical to SEQ ID NO: 94534
  derived and/or modified sequence opt2 from hemagglutinin__InfluenzaA__ADG59641

SEQ ID NO: 96449 - RNA, 1701 nt, Artificial Sequence; identical to SEQ ID NO: 95024
  derived and/or modified sequence opt2 from hemagglutinin__InfluenzaA__ADG59643

SEQ ID NO: 96450 - RNA, 1701 nt, Artificial Sequence; identical to SEQ ID NO: 94168
  derived and/or modified sequence opt2 from hemagglutinin__InfluenzaA__ADG59644

SEQ ID NO: 96451 - RNA, 1701 nt, Artificial Sequence; identical to SEQ ID NO: 94181
  derived and/or modified sequence opt2 from hemagglutinin__InfluenzaA__ADG59646

SEQ ID NO: 96452 - RNA, 1701 nt, Artificial Sequence; identical to SEQ ID NO: 95282
  derived and/or modified sequence opt2 from hemagglutinin__InfluenzaA__ADG59647

SEQ ID NO: 96453 - RNA, 1701 nt, Artificial Sequence; identical to SEQ ID NO: 95345
  derived and/or modified sequence opt2 from hemagglutinin__InfluenzaA__ADG59648

SEQ ID NO: 96454 - RNA, 1701 nt, Artificial Sequence; identical to SEQ ID NO: 95345
  derived and/or modified sequence opt2 from hemagglutinin__InfluenzaA__ADG59649

SEQ ID NO: 96455 - RNA, 1701 nt, Artificial Sequence; identical to SEQ ID NO: 95345
  derived and/or modified sequence opt2 from hemagglutinin__InfluenzaA__ADG59650

SEQ ID NO: 96456 - RNA, 1701 nt, Artificial Sequence; identical to SEQ ID NO: 95345
  derived and/or modified sequence opt2 from hemagglutinin__InfluenzaA__ADG59651

SEQ ID NO: 96457 - RNA, 1701 nt, Artificial Sequence; identical to SEQ ID NO: 94181
  derived and/or modified sequence opt2 from hemagglutinin__InfluenzaA__ADG59652

SEQ ID NO: 96458 - RNA, 1701 nt, Artificial Sequence; identical to SEQ ID NO: 94181
  derived and/or modified sequence opt2 from hemagglutinin__InfluenzaA__ADG59653

SEQ ID NO: 96459 - RNA, 1701 nt, Artificial Sequence; identical to SEQ ID NO: 96445
  derived and/or modified sequence opt2 from hemagglutinin__InfluenzaA__ADG59655

SEQ ID NO: 96460 - RNA, 1701 nt, Artificial Sequence; identical to SEQ ID NO: 95282
  derived and/or modified sequence opt2 from hemagglutinin__InfluenzaA__ADG59656

SEQ ID NO: 96461 - RNA, 1701 nt, Artificial Sequence
  derived and/or modified sequence opt2 from hemagglutinin__InfluenzaA__ADG59657
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccacccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96462 - RNA, 1701 nt, Artificial Sequence
  derived and/or modified sequence opt2 from hemagglutinin__InfluenzaA__ADG59658
augaaggccauccucgucguccuccucuacaccuucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96463 - RNA, 1701 nt, Artificial Sequence; identical to SEQ ID NO: 94628
  derived and/or modified sequence opt2 from hemagglutinin__InfluenzaA__ADG59659

SEQ ID NO: 96464 - RNA, 1701 nt, Artificial Sequence; identical to SEQ ID NO: 94628
  derived and/or modified sequence opt2 from hemagglutinin__InfluenzaA__ADG59660

SEQ ID NO: 96465 - RNA, 1701 nt, Artificial Sequence; identical to SEQ ID NO: 94534
  derived and/or modified sequence opt2 from hemagglutinin__InfluenzaA__ADG59662

SEQ ID NO: 96466 - RNA, 1701 nt, Artificial Sequence
  derived and/or modified sequence opt2 from hemagglutinin__InfluenzaA__ADG59663
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccuuccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96467 - RNA, 1701 nt, Artificial Sequence; identical to SEQ ID NO: 94534
  derived and/or modified sequence opt2 from hemagglutinin__InfluenzaA__ADG59664

SEQ ID NO: 96468 - RNA, 1701 nt, Artificial Sequence
  derived and/or modified sequence opt2 from hemagglutinin__InfluenzaA__ADG59666
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccgccgucgccuccucccucguccucgucgucucccucggcgccaucuccuucuggaugugcuccaacggcucccuccagugccgcaucugcaucuga

SEQ ID NO: 96469 - RNA, 1701 nt, Artificial Sequence; identical to SEQ ID NO: 95283
  derived and/or modified sequence opt2 from hemagglutinin__InfluenzaA__ADG59667

SEQ ID NO: 96470 - RNA, 1701 nt, Artificial Sequence
  derived and/or modified sequence opt2 from hemagglutinin__InfluenzaA__ADG59669
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgaccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96471 - RNA, 1701 nt, Artificial Sequence; identical to SEQ ID NO: 96470
  derived and/or modified sequence opt2 from hemagglutinin__InfluenzaA__ADG59670

SEQ ID NO: 96472 - RNA, 1701 nt, Artificial Sequence; identical to SEQ ID NO: 96470
  derived and/or modified sequence opt2 from hemagglutinin__InfluenzaA__ADG59671

SEQ ID NO: 96473 - RNA, 1701 nt, Artificial Sequence; identical to SEQ ID NO: 96470
  derived and/or modified sequence opt2 from hemagglutinin__InfluenzaA__ADG59672

SEQ ID NO: 96474 - RNA, 1701 nt, Artificial Sequence
  derived and/or modified sequence opt2 from hemagglutinin__InfluenzaA__ADG59673
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcgagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96475 - RNA, 1701 nt, Artificial Sequence
  derived and/or modified sequence opt2 from hemagglutinin__InfluenzaA__ADG59674
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96476 - RNA, 1701 nt, Artificial Sequence
  derived and/or modified sequence opt2 from hemagglutinin__InfluenzaA__ADG59675
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96477 - RNA, 1701 nt, Artificial Sequence
  derived and/or modified sequence opt2 from hemagglutinin__InfluenzaA__ADG59676
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacgccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96478 - RNA, 1701 nt, Artificial Sequence; identical to SEQ ID NO: 95282
  derived and/or modified sequence opt2 from hemagglutinin__InfluenzaA__ADG59678

SEQ ID NO: 96479 - RNA, 1701 nt, Artificial Sequence; identical to SEQ ID NO: 96445
  derived and/or modified sequence opt2 from hemagglutinin__InfluenzaA__ADG59680

SEQ ID NO: 96480 - RNA, 1701 nt, Artificial Sequence; identical to SEQ ID NO: 96445
  derived and/or modified sequence opt2 from hemagglutinin__InfluenzaA__ADG59681

SEQ ID NO: 96481 - RNA, 1701 nt, Artificial Sequence
  derived and/or modified sequence opt2 from hemagglutinin__InfluenzaA__ADG59683
augaaggccauccucgucguccuccucuacaccuucgccaucgccaacgccgacacccucugcaucggcuaccacgccaacaacuccaccgacaccgucgacaccguccucaagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96482 - RNA, 1701 nt, Artificial Sequence; identical to SEQ ID NO: 95282
  derived and/or modified sequence opt2 from hemagglutinin__InfluenzaA__ADG59684

SEQ ID NO: 96483 - RNA, 1701 nt, Artificial Sequence
  derived and/or modified sequence opt2 from hemagglutinin__InfluenzaA__ADG59685
augaaggccauccucgucguccuccucuacaccuucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96484 - RNA, 1701 nt, Artificial Sequence; identical to SEQ ID NO: 95282
  derived and/or modified sequence opt2 from hemagglutinin__InfluenzaA__ADG59686

SEQ ID NO: 96485 - RNA, 1701 nt, Artificial Sequence; identical to SEQ ID NO: 96445
  derived and/or modified sequence opt2 from hemagglutinin__InfluenzaA__ADG59687

SEQ ID NO: 96486 - RNA, 1701 nt, Artificial Sequence
  derived and/or modified sequence opt2 from hemagglutinin__InfluenzaA__ADG59688
augaaggccauccucgucguccuccucuacaccaucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96487 - RNA, 1701 nt, Artificial Sequence; identical to SEQ ID NO: 94181
  derived and/or modified sequence opt2 from hemagglutinin__InfluenzaA__ADG59689

SEQ ID NO: 96488 - RNA, 1701 nt, Artificial Sequence; identical to SEQ ID NO: 94181
  derived and/or modified sequence opt2 from hemagglutinin__InfluenzaA__ADG59691

SEQ ID NO: 96489 - RNA, 1701 nt, Artificial Sequence
  derived and/or modified sequence opt2 from hemagglutinin__InfluenzaA__ADG59693
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96490 - RNA, 1701 nt, Artificial Sequence
  derived and/or modified sequence opt2 from hemagglutinin__InfluenzaA__ADG59696
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96491 - RNA, 1701 nt, Artificial Sequence
  derived and/or modified sequence opt2 from hemagglutinin__InfluenzaA__ADG59697
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagaacuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96492 - RNA, 1701 nt, Artificial Sequence
  derived and/or modified sequence opt2 from hemagglutinin__InfluenzaA__ADG59700
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccucaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96493 - RNA, 1701 nt, Artificial Sequence
  derived and/or modified sequence opt2 from hemagglutinin__InfluenzaA__ADG59701
augaaggccauccucgucguccuccucuacaccuucgccgccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96494 - RNA, 1701 nt, Artificial Sequence
  derived and/or modified sequence opt2 from hemagglutinin__InfluenzaA__ADG59702
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcaaccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96495 - RNA, 1701 nt, Artificial Sequence
  derived and/or modified sequence opt2 from hemagglutinin__InfluenzaA__ADG59703
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96496 - RNA, 1701 nt, Artificial Sequence; identical to SEQ ID NO: 94196
  derived and/or modified sequence opt2 from hemagglutinin__InfluenzaA__ADG76646

SEQ ID NO: 96497 - RNA, 1701 nt, Artificial Sequence
  derived and/or modified sequence opt2 from hemagglutinin__InfluenzaA__ADG76652
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96498 - RNA, 1701 nt, Artificial Sequence; identical to SEQ ID NO: 94423
  derived and/or modified sequence opt2 from hemagglutinin__InfluenzaA__ADH01808

SEQ ID NO: 96499 - RNA, 1701 nt, Artificial Sequence
  derived and/or modified sequence opt2 from hemagglutinin__InfluenzaA__ADH01818
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 96500 - RNA, 1701 nt, Artificial Sequence; identical to SEQ ID NO: 94423
  derived and/or modified sequence opt2 from hemagglutinin__InfluenzaA__ADH01828

SEQ ID NO: 96501 - RNA, 1701 nt, Artificial Sequence; identical to SEQ ID NO: 94181
  derived and/or modified sequence opt2 from hemagglutinin__InfluenzaA__ADH01838

SEQ ID NO: 96502 - RNA, 1701 nt, Artificial Sequence; identical to SEQ ID NO: 94423
  derived and/or modified sequence opt2 from hemagglutinin__InfluenzaA__ADH01848

SEQ ID NO: 96503 - RNA, 1701 nt, Artificial Sequence; identical to SEQ ID NO: 94423
  derived and/or modified sequence opt2 from hemagglutinin__InfluenzaA__ADH01858

SEQ ID NO: 96504 - RNA, 1701 nt, Artificial Sequence; identical to SEQ ID NO: 94181
  derived and/or modified sequence opt2 from hemagglutinin__InfluenzaA__ADH01868

SEQ ID NO: 96505 - RNA, 1701 nt, Artificial Sequence; identical to SEQ ID NO: 94181
  derived and/or modified sequence opt2 from hemagglutinin__InfluenzaA__ADH01878

SEQ ID NO: 96506 - RNA, 1701 nt, Artificial Sequence; identical to SEQ ID NO: 94423
  derived and/or modified sequence opt2 from hemagglutinin__InfluenzaA__ADH01888

SEQ ID NO: 96507 - RNA, 1701 nt, Artificial Sequence; identical to SEQ ID NO: 94181
  derived and/or modified sequence opt2 from hemagglutinin__InfluenzaA__ADH01898

SEQ ID NO: 96508 - RNA, 1701 nt, Artificial Sequence; identical to SEQ ID NO: 94272
  derived and/or modified sequence opt2 from hemagglutinin__InfluenzaA__ADH01908

SEQ ID NO: 96509 - RNA, 1701 nt, Artificial Sequence
  derived and/or modified sequence opt2 from hemagglutinin__InfluenzaA__ADH01918
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgaguccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96510 - RNA, 1701 nt, Artificial Sequence
  derived and/or modified sequence opt2 from hemagglutinin__InfluenzaA__ADH01928
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgccuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96511 - RNA, 1701 nt, Artificial Sequence
  derived and/or modified sequence opt2 from hemagglutinin__InfluenzaA__ADH01938
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacaagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96512 - RNA, 1701 nt, Artificial Sequence; identical to SEQ ID NO: 95345
  derived and/or modified sequence opt2 from hemagglutinin__InfluenzaA__ADH01948

SEQ ID NO: 96513 - RNA, 1701 nt, Artificial Sequence
  derived and/or modified sequence opt2 from hemagglutinin__InfluenzaA__ADH01958
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaacugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 96514 - RNA, 1701 nt, Artificial Sequence
  derived and/or modified sequence opt2 from hemagglutinin__InfluenzaA__ADH01968
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96515 - RNA, 1701 nt, Artificial Sequence; identical to SEQ ID NO: 95345
  derived and/or modified sequence opt2 from hemagglutinin__InfluenzaA__ADH01978

SEQ ID NO: 96516 - RNA, 1701 nt, Artificial Sequence; identical to SEQ ID NO: 95345
  derived and/or modified sequence opt2 from hemagglutinin__InfluenzaA__ADH01988

SEQ ID NO: 96517 - RNA, 1701 nt, Artificial Sequence; identical to SEQ ID NO: 96348
  derived and/or modified sequence opt2 from hemagglutinin__InfluenzaA__ADH01998

SEQ ID NO: 96518 - RNA, 1701 nt, Artificial Sequence
  derived and/or modified sequence opt2 from hemagglutinin__InfluenzaA__ADH02008
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96519 - RNA, 1701 nt, Artificial Sequence; identical to SEQ ID NO: 95345
  derived and/or modified sequence opt2 from hemagglutinin__InfluenzaA__ADI24508

SEQ ID NO: 96520 - RNA, 1701 nt, Artificial Sequence
  derived and/or modified sequence opt2 from hemagglutinin__InfluenzaA__ADI24515
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccuccccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaaguccaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96521 - RNA, 1701 nt, Artificial Sequence; identical to SEQ ID NO: 95345
  derived and/or modified sequence opt2 from hemagglutinin__InfluenzaA__ADI24517

SEQ ID NO: 96522 - RNA, 1701 nt, Artificial Sequence; identical to SEQ ID NO: 95345
  derived and/or modified sequence opt2 from hemagglutinin__InfluenzaA__ADI24519

SEQ ID NO: 96523 - RNA, 1701 nt, Artificial Sequence; identical to SEQ ID NO: 95345
  derived and/or modified sequence opt2 from hemagglutinin__InfluenzaA__ADI24521

SEQ ID NO: 96524 - RNA, 1701 nt, Artificial Sequence; identical to SEQ ID NO: 95733
  derived and/or modified sequence opt2 from hemagglutinin__InfluenzaA__ADI24523

SEQ ID NO: 96525 - RNA, 1701 nt, Artificial Sequence
  derived and/or modified sequence opt2 from hemagglutinin__InfluenzaA__ADI24525
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcgagcuccgcggcgucgccccccuccaccucggcaagugcaacaucgccggcuggauccucggcaaccccgagugcgagucccucuccaccgcccgcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96526 - RNA, 1701 nt, Artificial Sequence; identical to SEQ ID NO: 95345
  derived and/or modified sequence opt2 from hemagglutinin__InfluenzaA__ADI24527

SEQ ID NO: 96527 - RNA, 1701 nt, Artificial Sequence; identical to SEQ ID NO: 95733
  derived and/or modified sequence opt2 from hemagglutinin__InfluenzaA__ADI24529

SEQ ID NO: 96528 - RNA, 1701 nt, Artificial Sequence
  derived and/or modified sequence opt2 from hemagglutinin__InfluenzaA__ADI24531
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccuccucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugcaagaucugcaucuga

SEQ ID NO: 96529 - RNA, 1701 nt, Artificial Sequence
  derived and/or modified sequence opt2 from hemagglutinin__InfluenzaA__ADI24536
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96530 - RNA, 1701 nt, Artificial Sequence; identical to SEQ ID NO: 95345
  derived and/or modified sequence opt2 from hemagglutinin__InfluenzaA__ADI24546

SEQ ID NO: 96531 - RNA, 1701 nt, Artificial Sequence; identical to SEQ ID NO: 95345
  derived and/or modified sequence opt2 from hemagglutinin__InfluenzaA__ADI24553

SEQ ID NO: 96532 - RNA, 1701 nt, Artificial Sequence; identical to SEQ ID NO: 95345
  derived and/or modified sequence opt2 from hemagglutinin__InfluenzaA__ADI24555

SEQ ID NO: 96533 - RNA, 1701 nt, Artificial Sequence
  derived and/or modified sequence opt2 from hemagglutinin__InfluenzaA__ADI24557
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96534 - RNA, 1701 nt, Artificial Sequence; identical to SEQ ID NO: 95345
  derived and/or modified sequence opt2 from hemagglutinin__InfluenzaA__ADI24559

SEQ ID NO: 96535 - RNA, 1701 nt, Artificial Sequence
  derived and/or modified sequence opt2 from hemagglutinin__InfluenzaA__ADI24561
augaaggccauccucgucauccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96536 - RNA, 1701 nt, Artificial Sequence; identical to SEQ ID NO: 95345
  derived and/or modified sequence opt2 from hemagglutinin__InfluenzaA__ADI24563

SEQ ID NO: 96537 - RNA, 1701 nt, Artificial Sequence
  derived and/or modified sequence opt2 from hemagglutinin__InfluenzaA__ADI24565
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96538 - RNA, 1701 nt, Artificial Sequence; identical to SEQ ID NO: 95345
  derived and/or modified sequence opt2 from hemagglutinin__InfluenzaA__ADI24567

SEQ ID NO: 96539 - RNA, 1701 nt, Artificial Sequence
  derived and/or modified sequence opt2 from hemagglutinin__InfluenzaA__ADI24569
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96540 - RNA, 1701 nt, Artificial Sequence; identical to SEQ ID NO: 95345
  derived and/or modified sequence opt2 from hemagglutinin__InfluenzaA__ADI24571

SEQ ID NO: 96541 - RNA, 1701 nt, Artificial Sequence; identical to SEQ ID NO: 95733
  derived and/or modified sequence opt2 from hemagglutinin__InfluenzaA__ADI24573

SEQ ID NO: 96542 - RNA, 1701 nt, Artificial Sequence
  derived and/or modified sequence opt2 from hemagglutinin__InfluenzaA__ADI24575
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucgagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96543 - RNA, 1701 nt, Artificial Sequence; identical to SEQ ID NO: 95345
  derived and/or modified sequence opt2 from hemagglutinin__InfluenzaA__ADI24577

SEQ ID NO: 96544 - RNA, 1701 nt, Artificial Sequence
  derived and/or modified sequence opt2 from hemagglutinin__InfluenzaA__ADI24581
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggguccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96545 - RNA, 1701 nt, Artificial Sequence
  derived and/or modified sequence opt2 from hemagglutinin__InfluenzaA__ADI24583
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96546 - RNA, 1701 nt, Artificial Sequence
  derived and/or modified sequence opt2 from hemagglutinin__InfluenzaA__ADI24590
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96547 - RNA, 1701 nt, Artificial Sequence
  derived and/or modified sequence opt2 from hemagglutinin__InfluenzaA__ADI24597
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaacugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96548 - RNA, 1701 nt, Artificial Sequence; identical to SEQ ID NO: 96546
  derived and/or modified sequence opt2 from hemagglutinin__InfluenzaA__ADI24612

SEQ ID NO: 96549 - RNA, 1701 nt, Artificial Sequence
  derived and/or modified sequence opt2 from hemagglutinin__InfluenzaA__ADI24619
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgucgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96550 - RNA, 1701 nt, Artificial Sequence
  derived and/or modified sequence opt2 from hemagglutinin__InfluenzaA__ADI24621
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcaccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 96551 - RNA, 1701 nt, Artificial Sequence
  derived and/or modified sequence opt2 from hemagglutinin__InfluenzaA__ADI48184
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugggccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagcgcguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96552 - RNA, 1701 nt, Artificial Sequence; identical to SEQ ID NO: 95345
  derived and/or modified sequence opt2 from hemagglutinin__InfluenzaA__ADI48186

SEQ ID NO: 96553 - RNA, 1701 nt, Artificial Sequence
  derived and/or modified sequence opt2 from hemagglutinin__InfluenzaA__ADI48188
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccgacaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96554 - RNA, 1701 nt, Artificial Sequence
  derived and/or modified sequence opt2 from hemagglutinin__InfluenzaA__ADI48190
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96555 - RNA, 1701 nt, Artificial Sequence
  derived and/or modified sequence opt2 from hemagglutinin__InfluenzaA__ADI48192
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucaccaucuacuccaccgucgccuccucccucguccucgucgucucccucggcgccaucuccuucuggaugugcuccaacggcucccuccagugccgcaucugcaucuga

SEQ ID NO: 96556 - RNA, 1701 nt, Artificial Sequence
  derived and/or modified sequence opt2 from hemagglutinin__InfluenzaA__ADI48194
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucucccucgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96557 - RNA, 1701 nt, Artificial Sequence
  derived and/or modified sequence opt2 from hemagglutinin__InfluenzaA__ADI48196
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgacuccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96558 - RNA, 1701 nt, Artificial Sequence; identical to SEQ ID NO: 95345
  derived and/or modified sequence opt2 from hemagglutinin__InfluenzaA__ADI48198

SEQ ID NO: 96559 - RNA, 1701 nt, Artificial Sequence; identical to SEQ ID NO: 95345
  derived and/or modified sequence opt2 from hemagglutinin__InfluenzaA__ADI48200

SEQ ID NO: 96560 - RNA, 1701 nt, Artificial Sequence
  derived and/or modified sequence opt2 from hemagglutinin__InfluenzaA__ADI48202
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaucuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96561 - RNA, 1701 nt, Artificial Sequence
  derived and/or modified sequence opt2 from hemagglutinin__InfluenzaA__ADI48204
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgucgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaagaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96562 - RNA, 1701 nt, Artificial Sequence; identical to SEQ ID NO: 95345
  derived and/or modified sequence opt2 from hemagglutinin__InfluenzaA__ADI48208

SEQ ID NO: 96563 - RNA, 1701 nt, Artificial Sequence; identical to SEQ ID NO: 95345
  derived and/or modified sequence opt2 from hemagglutinin__InfluenzaA__ADI48210

SEQ ID NO: 96564 - RNA, 1701 nt, Artificial Sequence
  derived and/or modified sequence opt2 from hemagglutinin__InfluenzaA__ADI48212
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96565 - RNA, 1701 nt, Artificial Sequence
  derived and/or modified sequence opt2 from hemagglutinin__InfluenzaA__ADI48214
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgccgucucccucggcgccaucuccuucuggaugugcuccaacggcucccuccagugccgcaucugcaucuga

SEQ ID NO: 96566 - RNA, 1701 nt, Artificial Sequence; identical to SEQ ID NO: 96564
  derived and/or modified sequence opt2 from hemagglutinin__InfluenzaA__ADI48216

SEQ ID NO: 96567 - RNA, 1701 nt, Artificial Sequence
  derived and/or modified sequence opt2 from hemagglutinin__InfluenzaA__ADI48218
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccaggacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96568 - RNA, 1701 nt, Artificial Sequence
  derived and/or modified sequence opt2 from hemagglutinin__InfluenzaA__ADI48220
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgagaccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucggcuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96569 - RNA, 1701 nt, Artificial Sequence
  derived and/or modified sequence opt2 from hemagglutinin__InfluenzaA__ADI48622
augaaggccauccucgucuuccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96570 - RNA, 1701 nt, Artificial Sequence
  derived and/or modified sequence opt2 from hemagglutinin__InfluenzaA__ADI48632
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcguccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96571 - RNA, 1701 nt, Artificial Sequence; identical to SEQ ID NO: 94423
  derived and/or modified sequence opt2 from hemagglutinin__InfluenzaA__ADI48642

SEQ ID NO: 96572 - RNA, 1701 nt, Artificial Sequence; identical to SEQ ID NO: 94423
  derived and/or modified sequence opt2 from hemagglutinin__InfluenzaA__ADI48652

SEQ ID NO: 96573 - RNA, 1701 nt, Artificial Sequence
  derived and/or modified sequence opt2 from hemagglutinin__InfluenzaA__ADI48672
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaacaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96574 - RNA, 1701 nt, Artificial Sequence; identical to SEQ ID NO: 94181
  derived and/or modified sequence opt2 from hemagglutinin__InfluenzaA__ADI48682

SEQ ID NO: 96575 - RNA, 1701 nt, Artificial Sequence; identical to SEQ ID NO: 94423
  derived and/or modified sequence opt2 from hemagglutinin__InfluenzaA__ADI48692

SEQ ID NO: 96576 - RNA, 1701 nt, Artificial Sequence; identical to SEQ ID NO: 94361
  derived and/or modified sequence opt2 from hemagglutinin__InfluenzaA__ADI48702

SEQ ID NO: 96577 - RNA, 1701 nt, Artificial Sequence; identical to SEQ ID NO: 94423
  derived and/or modified sequence opt2 from hemagglutinin__InfluenzaA__ADI48712

SEQ ID NO: 96578 - RNA, 1701 nt, Artificial Sequence; identical to SEQ ID NO: 94423
  derived and/or modified sequence opt2 from hemagglutinin__InfluenzaA__ADI48722

SEQ ID NO: 96579 - RNA, 1701 nt, Artificial Sequence; identical to SEQ ID NO: 94181
  derived and/or modified sequence opt2 from hemagglutinin__InfluenzaA__ADI48732

SEQ ID NO: 96580 - RNA, 1701 nt, Artificial Sequence; identical to SEQ ID NO: 94181
  derived and/or modified sequence opt2 from hemagglutinin__InfluenzaA__ADI48742

SEQ ID NO: 96581 - RNA, 1701 nt, Artificial Sequence
  derived and/or modified sequence opt2 from hemagglutinin__InfluenzaA__ADI48752
auggaggccauccucgucuuccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96582 - RNA, 1701 nt, Artificial Sequence; identical to SEQ ID NO: 94423
  derived and/or modified sequence opt2 from hemagglutinin__InfluenzaA__ADI48762

SEQ ID NO: 96583 - RNA, 1701 nt, Artificial Sequence
  derived and/or modified sequence opt2 from hemagglutinin__InfluenzaA__ADI48772
auggaggccauccucgucguccuccucuacaccuucgccaccgccaacgccgacacccucugcaucggcuaccaggccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96584 - RNA, 1701 nt, Artificial Sequence
  derived and/or modified sequence opt2 from hemagglutinin__InfluenzaA__ADI48782
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96585 - RNA, 1701 nt, Artificial Sequence
  derived and/or modified sequence opt2 from hemagglutinin__InfluenzaA__ADI48792
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacaucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96586 - RNA, 1701 nt, Artificial Sequence
  derived and/or modified sequence opt2 from hemagglutinin__InfluenzaA__ADI49029
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccucaagaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96587 - RNA, 1701 nt, Artificial Sequence; identical to SEQ ID NO: 94423
  derived and/or modified sequence opt2 from hemagglutinin__InfluenzaA__ADI49240

SEQ ID NO: 96588 - RNA, 1701 nt, Artificial Sequence; identical to SEQ ID NO: 94423
  derived and/or modified sequence opt2 from hemagglutinin__InfluenzaA__ADI49260

SEQ ID NO: 96589 - RNA, 1701 nt, Artificial Sequence
  derived and/or modified sequence opt2 from hemagglutinin__InfluenzaA__ADI49270
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgcccgcgagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96590 - RNA, 1701 nt, Artificial Sequence; identical to SEQ ID NO: 94423
  derived and/or modified sequence opt2 from hemagglutinin__InfluenzaA__ADI49280

SEQ ID NO: 96591 - RNA, 1701 nt, Artificial Sequence; identical to SEQ ID NO: 94423
  derived and/or modified sequence opt2 from hemagglutinin__InfluenzaA__ADI49312

SEQ ID NO: 96592 - RNA, 1701 nt, Artificial Sequence; identical to SEQ ID NO: 94423
  derived and/or modified sequence opt2 from hemagglutinin__InfluenzaA__ADI49322

SEQ ID NO: 96593 - RNA, 1701 nt, Artificial Sequence; identical to SEQ ID NO: 94423
  derived and/or modified sequence opt2 from hemagglutinin__InfluenzaA__ADI49332

SEQ ID NO: 96594 - RNA, 1701 nt, Artificial Sequence; identical to SEQ ID NO: 94750
  derived and/or modified sequence opt2 from hemagglutinin__InfluenzaA__ADI49342

SEQ ID NO: 96595 - RNA, 1701 nt, Artificial Sequence; identical to SEQ ID NO: 94423
  derived and/or modified sequence opt2 from hemagglutinin__InfluenzaA__ADI49352

SEQ ID NO: 96596 - RNA, 1701 nt, Artificial Sequence; identical to SEQ ID NO: 94181
  derived and/or modified sequence opt2 from hemagglutinin__InfluenzaA__ADI49362

SEQ ID NO: 96597 - RNA, 1701 nt, Artificial Sequence; identical to SEQ ID NO: 95733
  derived and/or modified sequence opt2 from hemagglutinin__InfluenzaA__ADI49382

SEQ ID NO: 96598 - RNA, 1701 nt, Artificial Sequence; identical to SEQ ID NO: 94534
  derived and/or modified sequence opt2 from hemagglutinin__InfluenzaA__ADI49392

SEQ ID NO: 96599 - RNA, 1701 nt, Artificial Sequence; identical to SEQ ID NO: 94168
  derived and/or modified sequence opt2 from hemagglutinin__InfluenzaA__ADI49717

SEQ ID NO: 96600 - RNA, 1701 nt, Artificial Sequence
  derived and/or modified sequence opt2 from hemagglutinin__InfluenzaA__ADI49727
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccaucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96601 - RNA, 1701 nt, Artificial Sequence; identical to SEQ ID NO: 94168
  derived and/or modified sequence opt2 from hemagglutinin__InfluenzaA__ADI49737

SEQ ID NO: 96602 - RNA, 1701 nt, Artificial Sequence; identical to SEQ ID NO: 94168
  derived and/or modified sequence opt2 from hemagglutinin__InfluenzaA__ADI49747

SEQ ID NO: 96603 - RNA, 1701 nt, Artificial Sequence; identical to SEQ ID NO: 94168
  derived and/or modified sequence opt2 from hemagglutinin__InfluenzaA__ADI49757

SEQ ID NO: 96604 - RNA, 1701 nt, Artificial Sequence; identical to SEQ ID NO: 94168
  derived and/or modified sequence opt2 from hemagglutinin__InfluenzaA__ADI49767

SEQ ID NO: 96605 - RNA, 1701 nt, Artificial Sequence
  derived and/or modified sequence opt2 from hemagglutinin__InfluenzaA__ADI49777
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96606 - RNA, 1701 nt, Artificial Sequence
  derived and/or modified sequence opt2 from hemagglutinin__InfluenzaA__ADI49787
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccaucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96607 - RNA, 1701 nt, Artificial Sequence; identical to SEQ ID NO: 95516
  derived and/or modified sequence opt2 from hemagglutinin__InfluenzaA__ADI49822

SEQ ID NO: 96608 - RNA, 1701 nt, Artificial Sequence
  derived and/or modified sequence opt2 from hemagglutinin__InfluenzaA__ADI50027
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaaguacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggccaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96609 - RNA, 1701 nt, Artificial Sequence
  derived and/or modified sequence opt2 from hemagglutinin__InfluenzaA__ADI52834
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 96610 - RNA, 1701 nt, Artificial Sequence
  derived and/or modified sequence opt2 from hemagglutinin__InfluenzaA__ADI52835
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96611 - RNA, 1701 nt, Artificial Sequence
  derived and/or modified sequence opt2 from hemagglutinin__InfluenzaA__ADI52836
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagcgccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96612 - RNA, 1701 nt, Artificial Sequence
  derived and/or modified sequence opt2 from hemagglutinin__InfluenzaA__ADI52837
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggucaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaacggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96613 - RNA, 1701 nt, Artificial Sequence; identical to SEQ ID NO: 94979
  derived and/or modified sequence opt2 from hemagglutinin__InfluenzaA__ADI72915

SEQ ID NO: 96614 - RNA, 1701 nt, Artificial Sequence; identical to SEQ ID NO: 94979
  derived and/or modified sequence opt2 from hemagglutinin__InfluenzaA__ADI72916

SEQ ID NO: 96615 - RNA, 1701 nt, Artificial Sequence; identical to SEQ ID NO: 94979
  derived and/or modified sequence opt2 from hemagglutinin__InfluenzaA__ADI72917

SEQ ID NO: 96616 - RNA, 1701 nt, Artificial Sequence
  derived and/or modified sequence opt2 from hemagglutinin__InfluenzaA__ADI72918
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgaccgcggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96617 - RNA, 1701 nt, Artificial Sequence; identical to SEQ ID NO: 94979
  derived and/or modified sequence opt2 from hemagglutinin__InfluenzaA__ADI72919

SEQ ID NO: 96618 - RNA, 1701 nt, Artificial Sequence; identical to SEQ ID NO: 94979
  derived and/or modified sequence opt2 from hemagglutinin__InfluenzaA__ADI72920

SEQ ID NO: 96619 - RNA, 1701 nt, Artificial Sequence
  derived and/or modified sequence opt2 from hemagglutinin__InfluenzaA__ADI72921
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgcccucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96620 - RNA, 1701 nt, Artificial Sequence; identical to SEQ ID NO: 94181
  derived and/or modified sequence opt2 from hemagglutinin__InfluenzaA__ADI72922

SEQ ID NO: 96621 - RNA, 1701 nt, Artificial Sequence
  derived and/or modified sequence opt2 from hemagglutinin__InfluenzaA__ADI72923
augaaggccauccucgucguccuccucuacaccuucgccaccuccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggccccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96622 - RNA, 1701 nt, Artificial Sequence; identical to SEQ ID NO: 94979
  derived and/or modified sequence opt2 from hemagglutinin__InfluenzaA__ADI72924

SEQ ID NO: 96623 - RNA, 1701 nt, Artificial Sequence; identical to SEQ ID NO: 94181
  derived and/or modified sequence opt2 from hemagglutinin__InfluenzaA__ADI72925

SEQ ID NO: 96624 - RNA, 1701 nt, Artificial Sequence
  derived and/or modified sequence opt2 from hemagglutinin__InfluenzaA__ADI72926
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccggcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96625 - RNA, 1701 nt, Artificial Sequence
  derived and/or modified sequence opt2 from hemagglutinin__InfluenzaA__ADI72927
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaccuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96626 - RNA, 1701 nt, Artificial Sequence
  derived and/or modified sequence opt2 from hemagglutinin__InfluenzaA__ADI72928
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcaaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96627 - RNA, 1701 nt, Artificial Sequence; identical to SEQ ID NO: 94181
  derived and/or modified sequence opt2 from hemagglutinin__InfluenzaA__ADI72929

SEQ ID NO: 96628 - RNA, 1701 nt, Artificial Sequence; identical to SEQ ID NO: 94181
  derived and/or modified sequence opt2 from hemagglutinin__InfluenzaA__ADI72930

SEQ ID NO: 96629 - RNA, 1701 nt, Artificial Sequence
  derived and/or modified sequence opt2 from hemagglutinin__InfluenzaA__ADI72931
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96630 - RNA, 1701 nt, Artificial Sequence; identical to SEQ ID NO: 95837
  derived and/or modified sequence opt2 from hemagglutinin__InfluenzaA__ADI72932

SEQ ID NO: 96631 - RNA, 1698 nt, Artificial Sequence
  derived and/or modified sequence opt2 from hemagglutinin__InfluenzaA__ADI75818
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccgagaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 96632 - RNA, 1698 nt, Artificial Sequence
  derived and/or modified sequence opt2 from hemagglutinin__InfluenzaA__ADI75851
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcggccuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 96633 - RNA, 1701 nt, Artificial Sequence; identical to SEQ ID NO: 93946
  derived and/or modified sequence opt2 from hemagglutinin__InfluenzaA__ADI75884

SEQ ID NO: 96634 - RNA, 1701 nt, Artificial Sequence; identical to SEQ ID NO: 93946
  derived and/or modified sequence opt2 from hemagglutinin__InfluenzaA__ADI75917

SEQ ID NO: 96635 - RNA, 1698 nt, Artificial Sequence
  derived and/or modified sequence opt2 from hemagglutinin__InfluenzaA__ADI77349
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucauccucuggggcguccaccacccccccaacauggccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacaccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 96636 - RNA, 1701 nt, Artificial Sequence; identical to SEQ ID NO: 94181
  derived and/or modified sequence opt2 from hemagglutinin__InfluenzaA__ADI77360

SEQ ID NO: 96637 - RNA, 1701 nt, Artificial Sequence
  derived and/or modified sequence opt2 from hemagglutinin__InfluenzaA__ADI99498
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96638 - RNA, 1701 nt, Artificial Sequence
  derived and/or modified sequence opt2 from hemagglutinin__InfluenzaA__ADI99560
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96639 - RNA, 1701 nt, Artificial Sequence; identical to SEQ ID NO: 96638
  derived and/or modified sequence opt2 from hemagglutinin__InfluenzaA__ADI99570

SEQ ID NO: 96640 - RNA, 1701 nt, Artificial Sequence; identical to SEQ ID NO: 96638
  derived and/or modified sequence opt2 from hemagglutinin__InfluenzaA__ADI99580

SEQ ID NO: 96641 - RNA, 1701 nt, Artificial Sequence; identical to SEQ ID NO: 95794
  derived and/or modified sequence opt2 from hemagglutinin__InfluenzaA__ADI99590

SEQ ID NO: 96642 - RNA, 1701 nt, Artificial Sequence
  derived and/or modified sequence opt2 from hemagglutinin__InfluenzaA__ADI99610
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96643 - RNA, 1701 nt, Artificial Sequence
  derived and/or modified sequence opt2 from hemagglutinin__InfluenzaA__ADI99620
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucaccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96644 - RNA, 1701 nt, Artificial Sequence
  derived and/or modified sequence opt2 from hemagglutinin__InfluenzaA__ADI99630
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagaacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96645 - RNA, 1701 nt, Artificial Sequence
  derived and/or modified sequence opt2 from hemagglutinin__InfluenzaA__ADI99640
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96646 - RNA, 1701 nt, Artificial Sequence; identical to SEQ ID NO: 95733
  derived and/or modified sequence opt2 from hemagglutinin__InfluenzaA__ADI99660

SEQ ID NO: 96647 - RNA, 1701 nt, Artificial Sequence
  derived and/or modified sequence opt2 from hemagglutinin__InfluenzaA__ADI99670
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacggcuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96648 - RNA, 1701 nt, Artificial Sequence
  derived and/or modified sequence opt2 from hemagglutinin__InfluenzaA__ADI99680
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggaccaucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96649 - RNA, 1701 nt, Artificial Sequence
  derived and/or modified sequence opt2 from hemagglutinin__InfluenzaA__ADI99690
augaaggccauccucgccguccuccucuacaccuucgccaucgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96650 - RNA, 1701 nt, Artificial Sequence
  derived and/or modified sequence opt2 from hemagglutinin__InfluenzaA__ADI99700
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcguccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96651 - RNA, 1701 nt, Artificial Sequence; identical to SEQ ID NO: 95830
  derived and/or modified sequence opt2 from hemagglutinin__InfluenzaA__ADI99710

SEQ ID NO: 96652 - RNA, 1701 nt, Artificial Sequence
  derived and/or modified sequence opt2 from hemagglutinin__InfluenzaA__ADI99720
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucucccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96653 - RNA, 1701 nt, Artificial Sequence; identical to SEQ ID NO: 94181
  derived and/or modified sequence opt2 from hemagglutinin__InfluenzaA__ADI99730

SEQ ID NO: 96654 - RNA, 1701 nt, Artificial Sequence; identical to SEQ ID NO: 94181
  derived and/or modified sequence opt2 from hemagglutinin__InfluenzaA__ADJ00497

SEQ ID NO: 96655 - RNA, 1701 nt, Artificial Sequence; identical to SEQ ID NO: 94181
  derived and/or modified sequence opt2 from hemagglutinin__InfluenzaA__ADJ00498

SEQ ID NO: 96656 - RNA, 1701 nt, Artificial Sequence; identical to SEQ ID NO: 95375
  derived and/or modified sequence opt2 from hemagglutinin__InfluenzaA__ADJ00501

SEQ ID NO: 96657 - RNA, 1701 nt, Artificial Sequence; identical to SEQ ID NO: 95345
  derived and/or modified sequence opt2 from hemagglutinin__InfluenzaA__ADJ18163

SEQ ID NO: 96658 - RNA, 1701 nt, Artificial Sequence; identical to SEQ ID NO: 95345
  derived and/or modified sequence opt2 from hemagglutinin__InfluenzaA__ADJ18165

SEQ ID NO: 96659 - RNA, 1701 nt, Artificial Sequence
  derived and/or modified sequence opt2 from hemagglutinin__InfluenzaA__ADJ18167
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccuacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96660 - RNA, 1701 nt, Artificial Sequence
  derived and/or modified sequence opt2 from hemagglutinin__InfluenzaA__ADJ18169
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96661 - RNA, 1701 nt, Artificial Sequence
  derived and/or modified sequence opt2 from hemagglutinin__InfluenzaA__ADJ18171
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccuggcccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuaccagaaccucaucuggcucgucaagaagggcaacuccuaccccaagcucuccaaguccuacauccacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgccagggccgcaugaacuacuacuggacccucgucgagcucggcgacaagaucaccuucgaggccaccggcaaccucgucgucccccgcuacgccuucgccauggagcgcaacgccggcuccggcaucaucaucuccgacacccccguccacaacugcaacaccaccugccagaccaccaccggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96662 - RNA, 1701 nt, Artificial Sequence; identical to SEQ ID NO: 95345
  derived and/or modified sequence opt2 from hemagglutinin__InfluenzaA__ADJ18173

SEQ ID NO: 96663 - RNA, 1701 nt, Artificial Sequence; identical to SEQ ID NO: 95345
  derived and/or modified sequence opt2 from hemagglutinin__InfluenzaA__ADJ18175

SEQ ID NO: 96664 - RNA, 1701 nt, Artificial Sequence
  derived and/or modified sequence opt2 from hemagglutinin__InfluenzaA__ADJ18177
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccguccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96665 - RNA, 1701 nt, Artificial Sequence
  derived and/or modified sequence opt2 from hemagglutinin__InfluenzaA__ADJ40444
augaaggccauccucgucguccuccucuacaccuucgccaccgccaacgccgacacccucugcaucggcuaccacgccaacaacuccaccgacaccgucgacaccguccucaagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96666 - RNA, 1701 nt, Artificial Sequence
  derived and/or modified sequence opt2 from hemagglutinin__InfluenzaA__ADJ40454
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucgagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96667 - RNA, 1701 nt, Artificial Sequence
  derived and/or modified sequence opt2 from hemagglutinin__InfluenzaA__ADJ40464
augaaggccauccucgucguccuccucuacaccuucgccaccgccaacaccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96668 - RNA, 1701 nt, Artificial Sequence
  derived and/or modified sequence opt2 from hemagglutinin__InfluenzaA__ADJ40474
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgccgccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96669 - RNA, 1701 nt, Artificial Sequence
  derived and/or modified sequence opt2 from hemagglutinin__InfluenzaA__ADJ40494
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagacccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96670 - RNA, 1701 nt, Artificial Sequence
  derived and/or modified sequence opt2 from hemagglutinin__InfluenzaA__ADJ40514
augaaggccguccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96671 - RNA, 1701 nt, Artificial Sequence; identical to SEQ ID NO: 94181
  derived and/or modified sequence opt2 from hemagglutinin__InfluenzaA__ADJ40524

SEQ ID NO: 96672 - RNA, 1701 nt, Artificial Sequence; identical to SEQ ID NO: 94534
  derived and/or modified sequence opt2 from hemagglutinin__InfluenzaA__ADJ40534

SEQ ID NO: 96673 - RNA, 1701 nt, Artificial Sequence
  derived and/or modified sequence opt2 from hemagglutinin__InfluenzaA__ADJ40554
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96674 - RNA, 1701 nt, Artificial Sequence; identical to SEQ ID NO: 94181
  derived and/or modified sequence opt2 from hemagglutinin__InfluenzaA__ADJ40564

SEQ ID NO: 96675 - RNA, 1701 nt, Artificial Sequence; identical to SEQ ID NO: 94181
  derived and/or modified sequence opt2 from hemagglutinin__InfluenzaA__ADJ40574

SEQ ID NO: 96676 - RNA, 1701 nt, Artificial Sequence; identical to SEQ ID NO: 95601
  derived and/or modified sequence opt2 from hemagglutinin__InfluenzaA__ADJ40584

SEQ ID NO: 96677 - RNA, 1701 nt, Artificial Sequence; identical to SEQ ID NO: 94181
  derived and/or modified sequence opt2 from hemagglutinin__InfluenzaA__ADJ40594

SEQ ID NO: 96678 - RNA, 1701 nt, Artificial Sequence; identical to SEQ ID NO: 94750
  derived and/or modified sequence opt2 from hemagglutinin__InfluenzaA__ADJ40604

SEQ ID NO: 96679 - RNA, 1701 nt, Artificial Sequence; identical to SEQ ID NO: 94750
  derived and/or modified sequence opt2 from hemagglutinin__InfluenzaA__ADJ40614

SEQ ID NO: 96680 - RNA, 1701 nt, Artificial Sequence; identical to SEQ ID NO: 94181
  derived and/or modified sequence opt2 from hemagglutinin__InfluenzaA__ADJ40634

SEQ ID NO: 96681 - RNA, 1701 nt, Artificial Sequence; identical to SEQ ID NO: 94181
  derived and/or modified sequence opt2 from hemagglutinin__InfluenzaA__ADJ40644

SEQ ID NO: 96682 - RNA, 1701 nt, Artificial Sequence; identical to SEQ ID NO: 94181
  derived and/or modified sequence opt2 from hemagglutinin__InfluenzaA__ADJ40654

SEQ ID NO: 96683 - RNA, 1701 nt, Artificial Sequence; identical to SEQ ID NO: 94181
  derived and/or modified sequence opt2 from hemagglutinin__InfluenzaA__ADJ40664

SEQ ID NO: 96684 - RNA, 1701 nt, Artificial Sequence; identical to SEQ ID NO: 94181
  derived and/or modified sequence opt2 from hemagglutinin__InfluenzaA__ADJ40674

SEQ ID NO: 96685 - RNA, 1701 nt, Artificial Sequence
  derived and/or modified sequence opt2 from hemagglutinin__InfluenzaA__ADJ41816
augaagaccaucaucgcccucuccuacauguucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccugcaccugcaagcgcggcuccaacgacuccuucuucucccgccucaacuggcucuacgaguccgaguccaaguaccccguccucaacgucaccaugcccaacaacggcaaguucgacaagcucuacaucuggggcauccaccaccccuccaccgacaaggagcagaccaaccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucuccuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 96686 - RNA, 1701 nt, Artificial Sequence; identical to SEQ ID NO: 94181
  derived and/or modified sequence opt2 from hemagglutinin__InfluenzaA__ADJ56640

SEQ ID NO: 96687 - RNA, 1701 nt, Artificial Sequence; identical to SEQ ID NO: 94979
  derived and/or modified sequence opt2 from hemagglutinin__InfluenzaA__ADJ56650

SEQ ID NO: 96688 - RNA, 1701 nt, Artificial Sequence; identical to SEQ ID NO: 94272
  derived and/or modified sequence opt2 from hemagglutinin__InfluenzaA__ADJ67983

SEQ ID NO: 96689 - RNA, 1701 nt, Artificial Sequence; identical to SEQ ID NO: 94272
  derived and/or modified sequence opt2 from hemagglutinin__InfluenzaA__ADJ67984

SEQ ID NO: 96690 - RNA, 1701 nt, Artificial Sequence; identical to SEQ ID NO: 94272
  derived and/or modified sequence opt2 from hemagglutinin__InfluenzaA__ADJ67985

SEQ ID NO: 96691 - RNA, 1701 nt, Artificial Sequence
  derived and/or modified sequence opt2 from hemagglutinin__InfluenzaA__ADJ80241
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96692 - RNA, 1701 nt, Artificial Sequence
  derived and/or modified sequence opt2 from hemagglutinin__InfluenzaA__ADJ80242
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 96693 - RNA, 1701 nt, Artificial Sequence; identical to SEQ ID NO: 95733
  derived and/or modified sequence opt2 from hemagglutinin__InfluenzaA__ADJ80243

SEQ ID NO: 96694 - RNA, 1701 nt, Artificial Sequence; identical to SEQ ID NO: 94181
  derived and/or modified sequence opt2 from hemagglutinin__InfluenzaA__ADJ80634

SEQ ID NO: 96695 - RNA, 1701 nt, Artificial Sequence; identical to SEQ ID NO: 96183
  derived and/or modified sequence opt2 from hemagglutinin__InfluenzaA__ADJ80644

SEQ ID NO: 96696 - RNA, 1701 nt, Artificial Sequence; identical to SEQ ID NO: 96183
  derived and/or modified sequence opt2 from hemagglutinin__InfluenzaA__ADJ80654

SEQ ID NO: 96697 - RNA, 1701 nt, Artificial Sequence; identical to SEQ ID NO: 95345
  derived and/or modified sequence opt2 from hemagglutinin__InfluenzaA__ADJ80674

SEQ ID NO: 96698 - RNA, 1701 nt, Artificial Sequence; identical to SEQ ID NO: 95345
  derived and/or modified sequence opt2 from hemagglutinin__InfluenzaA__ADJ80684

SEQ ID NO: 96699 - RNA, 1701 nt, Artificial Sequence
  derived and/or modified sequence opt2 from hemagglutinin__InfluenzaA__ADJ80694
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaaccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 96700 - RNA, 1701 nt, Artificial Sequence; identical to SEQ ID NO: 95345
  derived and/or modified sequence opt2 from hemagglutinin__InfluenzaA__ADJ80704

SEQ ID NO: 96701 - RNA, 1701 nt, Artificial Sequence
  derived and/or modified sequence opt2 from hemagglutinin__InfluenzaA__ADJ80714
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgccgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96702 - RNA, 1701 nt, Artificial Sequence; identical to SEQ ID NO: 94181
  derived and/or modified sequence opt2 from hemagglutinin__InfluenzaA__ADJ80724

SEQ ID NO: 96703 - RNA, 1701 nt, Artificial Sequence; identical to SEQ ID NO: 95345
  derived and/or modified sequence opt2 from hemagglutinin__InfluenzaA__ADJ80734

SEQ ID NO: 96704 - RNA, 1701 nt, Artificial Sequence; identical to SEQ ID NO: 95345
  derived and/or modified sequence opt2 from hemagglutinin__InfluenzaA__ADJ80744

SEQ ID NO: 96705 - RNA, 1701 nt, Artificial Sequence; identical to SEQ ID NO: 95345
  derived and/or modified sequence opt2 from hemagglutinin__InfluenzaA__ADJ80754

SEQ ID NO: 96706 - RNA, 1701 nt, Artificial Sequence
  derived and/or modified sequence opt2 from hemagglutinin__InfluenzaA__ADJ80774
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 96707 - RNA, 1701 nt, Artificial Sequence
  derived and/or modified sequence opt2 from hemagglutinin__InfluenzaA__ADJ80784
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96708 - RNA, 1701 nt, Artificial Sequence; identical to SEQ ID NO: 95345
  derived and/or modified sequence opt2 from hemagglutinin__InfluenzaA__ADJ80794

SEQ ID NO: 96709 - RNA, 1701 nt, Artificial Sequence; identical to SEQ ID NO: 96183
  derived and/or modified sequence opt2 from hemagglutinin__InfluenzaA__ADJ80804

SEQ ID NO: 96710 - RNA, 1701 nt, Artificial Sequence
  derived and/or modified sequence opt2 from hemagglutinin__InfluenzaA__ADJ80814
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96711 - RNA, 1701 nt, Artificial Sequence
  derived and/or modified sequence opt2 from hemagglutinin__InfluenzaA__ADJ80834
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacuccggcuccggcaucaucaucuccgacacccccguccacuacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96712 - RNA, 1701 nt, Artificial Sequence; identical to SEQ ID NO: 96383
  derived and/or modified sequence opt2 from hemagglutinin__InfluenzaA__ADJ80848

SEQ ID NO: 96713 - RNA, 1701 nt, Artificial Sequence
  derived and/or modified sequence opt2 from hemagglutinin__InfluenzaA__ADJ80858
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96714 - RNA, 1701 nt, Artificial Sequence
  derived and/or modified sequence opt2 from hemagglutinin__InfluenzaA__ADJ80868
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccaacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcggcaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96715 - RNA, 1701 nt, Artificial Sequence; identical to SEQ ID NO: 95345
  derived and/or modified sequence opt2 from hemagglutinin__InfluenzaA__ADJ80883

SEQ ID NO: 96716 - RNA, 1701 nt, Artificial Sequence; identical to SEQ ID NO: 95345
  derived and/or modified sequence opt2 from hemagglutinin__InfluenzaA__ADJ80893

SEQ ID NO: 96717 - RNA, 1701 nt, Artificial Sequence; identical to SEQ ID NO: 95345
  derived and/or modified sequence opt2 from hemagglutinin__InfluenzaA__ADJ80910

SEQ ID NO: 96718 - RNA, 1701 nt, Artificial Sequence; identical to SEQ ID NO: 94181
  derived and/or modified sequence opt2 from hemagglutinin__InfluenzaA__ADJ80927

SEQ ID NO: 96719 - RNA, 1701 nt, Artificial Sequence
  derived and/or modified sequence opt2 from hemagglutinin__InfluenzaA__ADJ80937
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagucccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96720 - RNA, 1701 nt, Artificial Sequence; identical to SEQ ID NO: 95345
  derived and/or modified sequence opt2 from hemagglutinin__InfluenzaA__ADJ80947

SEQ ID NO: 96721 - RNA, 1701 nt, Artificial Sequence; identical to SEQ ID NO: 95345
  derived and/or modified sequence opt2 from hemagglutinin__InfluenzaA__ADJ80967

SEQ ID NO: 96722 - RNA, 1701 nt, Artificial Sequence; identical to SEQ ID NO: 95345
  derived and/or modified sequence opt2 from hemagglutinin__InfluenzaA__ADJ80977

SEQ ID NO: 96723 - RNA, 1701 nt, Artificial Sequence
  derived and/or modified sequence opt2 from hemagglutinin__InfluenzaA__ADJ80993
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccaacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96724 - RNA, 1701 nt, Artificial Sequence
  derived and/or modified sequence opt2 from hemagglutinin__InfluenzaA__ADJ81003
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96725 - RNA, 1701 nt, Artificial Sequence; identical to SEQ ID NO: 96383
  derived and/or modified sequence opt2 from hemagglutinin__InfluenzaA__ADJ81013

SEQ ID NO: 96726 - RNA, 1701 nt, Artificial Sequence
  derived and/or modified sequence opt2 from hemagglutinin__InfluenzaA__ADJ81023
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96727 - RNA, 1701 nt, Artificial Sequence; identical to SEQ ID NO: 95345
  derived and/or modified sequence opt2 from hemagglutinin__InfluenzaA__ADJ81033

SEQ ID NO: 96728 - RNA, 1701 nt, Artificial Sequence; identical to SEQ ID NO: 94181
  derived and/or modified sequence opt2 from hemagglutinin__InfluenzaA__ADJ81043

SEQ ID NO: 96729 - RNA, 1701 nt, Artificial Sequence
  derived and/or modified sequence opt2 from hemagglutinin__InfluenzaA__ADJ81053
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96730 - RNA, 1701 nt, Artificial Sequence; identical to SEQ ID NO: 95345
  derived and/or modified sequence opt2 from hemagglutinin__InfluenzaA__ADJ81063

SEQ ID NO: 96731 - RNA, 1701 nt, Artificial Sequence; identical to SEQ ID NO: 95125
  derived and/or modified sequence opt2 from hemagglutinin__InfluenzaA__ADJ84772

SEQ ID NO: 96732 - RNA, 1701 nt, Artificial Sequence
  derived and/or modified sequence opt2 from hemagglutinin__InfluenzaA__ADJ88782
augaagaccaucaucgcccucuccuacaugcucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcucggcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96733 - RNA, 1701 nt, Artificial Sequence
  derived and/or modified sequence opt2 from hemagglutinin__InfluenzaA__ADK21733
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96734 - RNA, 1701 nt, Artificial Sequence
  derived and/or modified sequence opt2 from hemagglutinin__InfluenzaA__ADK21743
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucuccaacuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96735 - RNA, 1701 nt, Artificial Sequence
  derived and/or modified sequence opt2 from hemagglutinin__InfluenzaA__ADK21753
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagggcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96736 - RNA, 1701 nt, Artificial Sequence
  derived and/or modified sequence opt2 from hemagglutinin__InfluenzaA__ADK21763
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96737 - RNA, 1701 nt, Artificial Sequence; identical to SEQ ID NO: 95345
  derived and/or modified sequence opt2 from hemagglutinin__InfluenzaA__ADK21773

SEQ ID NO: 96738 - RNA, 1701 nt, Artificial Sequence; identical to SEQ ID NO: 95345
  derived and/or modified sequence opt2 from hemagglutinin__InfluenzaA__ADK21783

SEQ ID NO: 96739 - RNA, 1701 nt, Artificial Sequence; identical to SEQ ID NO: 94181
  derived and/or modified sequence opt2 from hemagglutinin__InfluenzaA__ADK21813

SEQ ID NO: 96740 - RNA, 1701 nt, Artificial Sequence; identical to SEQ ID NO: 95601
  derived and/or modified sequence opt2 from hemagglutinin__InfluenzaA__ADK21823

SEQ ID NO: 96741 - RNA, 1701 nt, Artificial Sequence
  derived and/or modified sequence opt2 from hemagglutinin__InfluenzaA__ADK21833
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccgcgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96742 - RNA, 1701 nt, Artificial Sequence; identical to SEQ ID NO: 95345
  derived and/or modified sequence opt2 from hemagglutinin__InfluenzaA__ADK21843

SEQ ID NO: 96743 - RNA, 1701 nt, Artificial Sequence; identical to SEQ ID NO: 94534
  derived and/or modified sequence opt2 from hemagglutinin__InfluenzaA__ADK21853

SEQ ID NO: 96744 - RNA, 1701 nt, Artificial Sequence; identical to SEQ ID NO: 95830
  derived and/or modified sequence opt2 from hemagglutinin__InfluenzaA__ADK21863

SEQ ID NO: 96745 - RNA, 1701 nt, Artificial Sequence; identical to SEQ ID NO: 94628
  derived and/or modified sequence opt2 from hemagglutinin__InfluenzaA__ADK21873

SEQ ID NO: 96746 - RNA, 1701 nt, Artificial Sequence
  derived and/or modified sequence opt2 from hemagglutinin__InfluenzaA__ADK21883
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucguccccaaguacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96747 - RNA, 1701 nt, Artificial Sequence; identical to SEQ ID NO: 94181
  derived and/or modified sequence opt2 from hemagglutinin__InfluenzaA__ADK21893

SEQ ID NO: 96748 - RNA, 1701 nt, Artificial Sequence; identical to SEQ ID NO: 95778
  derived and/or modified sequence opt2 from hemagglutinin__InfluenzaA__ADK21903

SEQ ID NO: 96749 - RNA, 1701 nt, Artificial Sequence; identical to SEQ ID NO: 95891
  derived and/or modified sequence opt2 from hemagglutinin__InfluenzaA__ADK21913

SEQ ID NO: 96750 - RNA, 1701 nt, Artificial Sequence
  derived and/or modified sequence opt2 from hemagglutinin__InfluenzaA__ADK21923
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggcccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccacccucguccucgucgucucccucggcgccaucuccuucuggaugugcuccaacggcucccuccagugccgcaucugcaucuga

SEQ ID NO: 96751 - RNA, 1701 nt, Artificial Sequence
  derived and/or modified sequence opt2 from hemagglutinin__InfluenzaA__ADK21933
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccaacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96752 - RNA, 1701 nt, Artificial Sequence; identical to SEQ ID NO: 94181
  derived and/or modified sequence opt2 from hemagglutinin__InfluenzaA__ADK21943

SEQ ID NO: 96753 - RNA, 1701 nt, Artificial Sequence
  derived and/or modified sequence opt2 from hemagglutinin__InfluenzaA__ADK21953
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgaccacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucugggccauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96754 - RNA, 1701 nt, Artificial Sequence; identical to SEQ ID NO: 96368
  derived and/or modified sequence opt2 from hemagglutinin__InfluenzaA__ADK32390

SEQ ID NO: 96755 - RNA, 1701 nt, Artificial Sequence; identical to SEQ ID NO: 96368
  derived and/or modified sequence opt2 from hemagglutinin__InfluenzaA__ADK32400

SEQ ID NO: 96756 - RNA, 1701 nt, Artificial Sequence
  derived and/or modified sequence opt2 from hemagglutinin__InfluenzaA__ADK32420
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96757 - RNA, 1701 nt, Artificial Sequence; identical to SEQ ID NO: 95733
  derived and/or modified sequence opt2 from hemagglutinin__InfluenzaA__ADK32430

SEQ ID NO: 96758 - RNA, 1701 nt, Artificial Sequence
  derived and/or modified sequence opt2 from hemagglutinin__InfluenzaA__ADK32440
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96759 - RNA, 1701 nt, Artificial Sequence
  derived and/or modified sequence opt2 from hemagglutinin__InfluenzaA__ADK32450
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 96760 - RNA, 1701 nt, Artificial Sequence
  derived and/or modified sequence opt2 from hemagglutinin__InfluenzaA__ADK32460
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96761 - RNA, 1701 nt, Artificial Sequence; identical to SEQ ID NO: 95345
  derived and/or modified sequence opt2 from hemagglutinin__InfluenzaA__ADK32470

SEQ ID NO: 96762 - RNA, 1701 nt, Artificial Sequence
  derived and/or modified sequence opt2 from hemagglutinin__InfluenzaA__ADK32480
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96763 - RNA, 1701 nt, Artificial Sequence; identical to SEQ ID NO: 95345
  derived and/or modified sequence opt2 from hemagglutinin__InfluenzaA__ADK32490

SEQ ID NO: 96764 - RNA, 1701 nt, Artificial Sequence; identical to SEQ ID NO: 95345
  derived and/or modified sequence opt2 from hemagglutinin__InfluenzaA__ADK32502

SEQ ID NO: 96765 - RNA, 1701 nt, Artificial Sequence; identical to SEQ ID NO: 95817
  derived and/or modified sequence opt2 from hemagglutinin__InfluenzaA__ADK32637

SEQ ID NO: 96766 - RNA, 1701 nt, Artificial Sequence; identical to SEQ ID NO: 95345
  derived and/or modified sequence opt2 from hemagglutinin__InfluenzaA__ADK32647

SEQ ID NO: 96767 - RNA, 1701 nt, Artificial Sequence; identical to SEQ ID NO: 95509
  derived and/or modified sequence opt2 from hemagglutinin__InfluenzaA__ADK32657

SEQ ID NO: 96768 - RNA, 1701 nt, Artificial Sequence; identical to SEQ ID NO: 95733
  derived and/or modified sequence opt2 from hemagglutinin__InfluenzaA__ADK32677

SEQ ID NO: 96769 - RNA, 1701 nt, Artificial Sequence
  derived and/or modified sequence opt2 from hemagglutinin__InfluenzaA__ADK32687
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagaacuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96770 - RNA, 1701 nt, Artificial Sequence; identical to SEQ ID NO: 95972
  derived and/or modified sequence opt2 from hemagglutinin__InfluenzaA__ADK32697

SEQ ID NO: 96771 - RNA, 1701 nt, Artificial Sequence; identical to SEQ ID NO: 95345
  derived and/or modified sequence opt2 from hemagglutinin__InfluenzaA__ADK32776

SEQ ID NO: 96772 - RNA, 1701 nt, Artificial Sequence; identical to SEQ ID NO: 95733
  derived and/or modified sequence opt2 from hemagglutinin__InfluenzaA__ADK33621

SEQ ID NO: 96773 - RNA, 1701 nt, Artificial Sequence
  derived and/or modified sequence opt2 from hemagglutinin__InfluenzaA__ADK33631
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggucaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96774 - RNA, 1701 nt, Artificial Sequence; identical to SEQ ID NO: 95733
  derived and/or modified sequence opt2 from hemagglutinin__InfluenzaA__ADK33641

SEQ ID NO: 96775 - RNA, 1701 nt, Artificial Sequence; identical to SEQ ID NO: 95345
  derived and/or modified sequence opt2 from hemagglutinin__InfluenzaA__ADK33651

SEQ ID NO: 96776 - RNA, 1701 nt, Artificial Sequence; identical to SEQ ID NO: 95345
  derived and/or modified sequence opt2 from hemagglutinin__InfluenzaA__ADK33661

SEQ ID NO: 96777 - RNA, 1701 nt, Artificial Sequence; identical to SEQ ID NO: 95345
  derived and/or modified sequence opt2 from hemagglutinin__InfluenzaA__ADK33671

SEQ ID NO: 96778 - RNA, 1701 nt, Artificial Sequence
  derived and/or modified sequence opt2 from hemagglutinin__InfluenzaA__ADK33681
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96779 - RNA, 1701 nt, Artificial Sequence; identical to SEQ ID NO: 95794
  derived and/or modified sequence opt2 from hemagglutinin__InfluenzaA__ADK33691

SEQ ID NO: 96780 - RNA, 1701 nt, Artificial Sequence
  derived and/or modified sequence opt2 from hemagglutinin__InfluenzaA__ADK33701
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 96781 - RNA, 1701 nt, Artificial Sequence
  derived and/or modified sequence opt2 from hemagglutinin__InfluenzaA__ADK33711
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96782 - RNA, 1701 nt, Artificial Sequence
  derived and/or modified sequence opt2 from hemagglutinin__InfluenzaA__ADK33721
augaaggccauccucgucguccuccucuacaccuucgucaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96783 - RNA, 1701 nt, Artificial Sequence
  derived and/or modified sequence opt2 from hemagglutinin__InfluenzaA__ADK33731
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96784 - RNA, 1701 nt, Artificial Sequence; identical to SEQ ID NO: 96348
  derived and/or modified sequence opt2 from hemagglutinin__InfluenzaA__ADK33741

SEQ ID NO: 96785 - RNA, 1701 nt, Artificial Sequence; identical to SEQ ID NO: 94181
  derived and/or modified sequence opt2 from hemagglutinin__InfluenzaA__ADK33751

SEQ ID NO: 96786 - RNA, 1701 nt, Artificial Sequence
  derived and/or modified sequence opt2 from hemagglutinin__InfluenzaA__ADK33761
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcucucccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96787 - RNA, 1701 nt, Artificial Sequence; identical to SEQ ID NO: 95345
  derived and/or modified sequence opt2 from hemagglutinin__InfluenzaA__ADK33771

SEQ ID NO: 96788 - RNA, 1701 nt, Artificial Sequence; identical to SEQ ID NO: 95345
  derived and/or modified sequence opt2 from hemagglutinin__InfluenzaA__ADK33781

SEQ ID NO: 96789 - RNA, 1701 nt, Artificial Sequence; identical to SEQ ID NO: 95282
  derived and/or modified sequence opt2 from hemagglutinin__InfluenzaA__ADK33791

SEQ ID NO: 96790 - RNA, 1701 nt, Artificial Sequence; identical to SEQ ID NO: 96780
  derived and/or modified sequence opt2 from hemagglutinin__InfluenzaA__ADK33801

SEQ ID NO: 96791 - RNA, 1701 nt, Artificial Sequence
  derived and/or modified sequence opt2 from hemagglutinin__InfluenzaA__ADK33811
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96792 - RNA, 1701 nt, Artificial Sequence
  derived and/or modified sequence opt2 from hemagglutinin__InfluenzaA__ADK33821
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgccgucucccucggcgccaucuccuucuggaugugcuccaacggcucccuccagugccgcaucugcaucuga

SEQ ID NO: 96793 - RNA, 1701 nt, Artificial Sequence
  derived and/or modified sequence opt2 from hemagglutinin__InfluenzaA__ADK33831
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96794 - RNA, 1701 nt, Artificial Sequence; identical to SEQ ID NO: 95601
  derived and/or modified sequence opt2 from hemagglutinin__InfluenzaA__ADK33841

SEQ ID NO: 96795 - RNA, 1701 nt, Artificial Sequence; identical to SEQ ID NO: 96348
  derived and/or modified sequence opt2 from hemagglutinin__InfluenzaA__ADK33851

SEQ ID NO: 96796 - RNA, 1701 nt, Artificial Sequence; identical to SEQ ID NO: 94181
  derived and/or modified sequence opt2 from hemagglutinin__InfluenzaA__ADK33861

SEQ ID NO: 96797 - RNA, 1701 nt, Artificial Sequence
  derived and/or modified sequence opt2 from hemagglutinin__InfluenzaA__ADK33871
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucaucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 96798 - RNA, 1701 nt, Artificial Sequence
  derived and/or modified sequence opt2 from hemagglutinin__InfluenzaA__ADK33881
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 96799 - RNA, 1701 nt, Artificial Sequence
  derived and/or modified sequence opt2 from hemagglutinin__InfluenzaA__ADK33891
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96800 - RNA, 1701 nt, Artificial Sequence; identical to SEQ ID NO: 96348
  derived and/or modified sequence opt2 from hemagglutinin__InfluenzaA__ADK33901

SEQ ID NO: 96801 - RNA, 1701 nt, Artificial Sequence
  derived and/or modified sequence opt2 from hemagglutinin__InfluenzaA__ADK33911
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96802 - RNA, 1701 nt, Artificial Sequence
  derived and/or modified sequence opt2 from hemagglutinin__InfluenzaA__ADK33931
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 96803 - RNA, 1701 nt, Artificial Sequence
  derived and/or modified sequence opt2 from hemagglutinin__InfluenzaA__ADK33941
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96804 - RNA, 1701 nt, Artificial Sequence; identical to SEQ ID NO: 96801
  derived and/or modified sequence opt2 from hemagglutinin__InfluenzaA__ADK33951

SEQ ID NO: 96805 - RNA, 1701 nt, Artificial Sequence; identical to SEQ ID NO: 95345
  derived and/or modified sequence opt2 from hemagglutinin__InfluenzaA__ADK33961

SEQ ID NO: 96806 - RNA, 1701 nt, Artificial Sequence; identical to SEQ ID NO: 95125
  derived and/or modified sequence opt2 from hemagglutinin__InfluenzaA__ADK45312

SEQ ID NO: 96807 - RNA, 1701 nt, Artificial Sequence
  derived and/or modified sequence opt2 from hemagglutinin__InfluenzaA__ADK45410
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96808 - RNA, 1701 nt, Artificial Sequence
  derived and/or modified sequence opt2 from hemagglutinin__InfluenzaA__ADK45421
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96809 - RNA, 1701 nt, Artificial Sequence
  derived and/or modified sequence opt2 from hemagglutinin__InfluenzaA__ADK45432
augaagaccaucaucgcccucuccuacacccucugccucgucuucgcccagaagcucccccgcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacaacccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96810 - RNA, 1701 nt, Artificial Sequence; identical to SEQ ID NO: 93946
  derived and/or modified sequence opt2 from hemagglutinin__InfluenzaA__ADK45443

SEQ ID NO: 96811 - RNA, 1701 nt, Artificial Sequence; identical to SEQ ID NO: 96345
  derived and/or modified sequence opt2 from hemagglutinin__InfluenzaA__ADK48798

SEQ ID NO: 96812 - RNA, 1701 nt, Artificial Sequence; identical to SEQ ID NO: 95345
  derived and/or modified sequence opt2 from hemagglutinin__InfluenzaA__ADK62683

SEQ ID NO: 96813 - RNA, 1701 nt, Artificial Sequence
  derived and/or modified sequence opt2 from hemagglutinin__InfluenzaA__ADK62693
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcggcucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96814 - RNA, 1701 nt, Artificial Sequence; identical to SEQ ID NO: 95282
  derived and/or modified sequence opt2 from hemagglutinin__InfluenzaA__ADK62703

SEQ ID NO: 96815 - RNA, 1701 nt, Artificial Sequence
  derived and/or modified sequence opt2 from hemagglutinin__InfluenzaA__ADK64992
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccaguaccgcaucugcaucuga

SEQ ID NO: 96816 - RNA, 1701 nt, Artificial Sequence
  derived and/or modified sequence opt2 from hemagglutinin__InfluenzaA__ADK65001
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugccucgaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96817 - RNA, 1701 nt, Artificial Sequence
  derived and/or modified sequence opt2 from hemagglutinin__InfluenzaA__ADK65009
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucggcgccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96818 - RNA, 1701 nt, Artificial Sequence
  derived and/or modified sequence opt2 from hemagglutinin__InfluenzaA__ADK87287
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccucaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96819 - RNA, 1701 nt, Artificial Sequence
  derived and/or modified sequence opt2 from hemagglutinin__InfluenzaA__ADK87288
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccaccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96820 - RNA, 1701 nt, Artificial Sequence
  derived and/or modified sequence opt2 from hemagglutinin__InfluenzaA__ADK87289
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucggcuucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucggcaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96821 - RNA, 1701 nt, Artificial Sequence
  derived and/or modified sequence opt2 from hemagglutinin__InfluenzaA__ADK87291
augaagaccaucaucgcccucuccuacauccagugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucucccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucggcaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96822 - RNA, 1701 nt, Artificial Sequence
  derived and/or modified sequence opt2 from hemagglutinin__InfluenzaA__ADK87293
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucuccaagcucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96823 - RNA, 1701 nt, Artificial Sequence
  derived and/or modified sequence opt2 from hemagglutinin__InfluenzaA__ADK87295
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcucccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgccgcaacaucugcaucuga

SEQ ID NO: 96824 - RNA, 1701 nt, Artificial Sequence
  derived and/or modified sequence opt2 from hemagglutinin__InfluenzaA__ADK87296
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcugcgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96825 - RNA, 1701 nt, Artificial Sequence
  derived and/or modified sequence opt2 from hemagglutinin__InfluenzaA__ADK87298
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacuccggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaacaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaaccccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96826 - RNA, 1701 nt, Artificial Sequence
  derived and/or modified sequence opt2 from hemagglutinin__InfluenzaA__ADK87300
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacucccucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucgcccccaacggcuccauccccaacgacaaguccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96827 - RNA, 1701 nt, Artificial Sequence
  derived and/or modified sequence opt2 from hemagglutinin__InfluenzaA__ADK87302
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 96828 - RNA, 1701 nt, Artificial Sequence
  derived and/or modified sequence opt2 from hemagglutinin__InfluenzaA__ADK87304
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacggccacgacgucuaccgcgacgaggcccucaacaaccgcuuccagaucaagggcgucgagcucaaguccggcuacaaggacugguuccucuggaucuccuucgccaucuccugcuuccuccucugcgucgcccuccucggcuucaucaugugggccugccagaagggcaacauccgcugcaacaucugcaucuga

SEQ ID NO: 96829 - RNA, 1701 nt, Artificial Sequence
  derived and/or modified sequence opt2 from hemagglutinin__InfluenzaA__ADK87306
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccgccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucggccgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcguccgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccauggaccagaucaacggcaagcucaaccgccucaucggcaagaccaacgagaagcuccaccagaccgagaaggaguucuccgaggucgagggccgcauccaggaccucgagaaguacgucgaggacaccaagaucgaccucugguccuacaacgccgagcuccucgucgcccucgagucccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96830 - RNA, 1701 nt, Artificial Sequence
  derived and/or modified sequence opt2 from hemagglutinin__InfluenzaA__ADK87308
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccuccgcgucgcccuccucggcuucaucaugugggccugccagaagggcaacauccgcugcaacaucugcaucuga

SEQ ID NO: 96831 - RNA, 1701 nt, Artificial Sequence
  derived and/or modified sequence opt2 from hemagglutinin__InfluenzaA__ADK87309
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccucuccggcuucaucaugugggccugccagaagggcaacauccgcugcaacaucugcaucuga

SEQ ID NO: 96832 - RNA, 1701 nt, Artificial Sequence
  derived and/or modified sequence opt2 from hemagglutinin__InfluenzaA__ADK87310
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccggcuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96833 - RNA, 1701 nt, Artificial Sequence
  derived and/or modified sequence opt2 from hemagglutinin__InfluenzaA__ADK87311
augaaggccauccucgucguccuccucuacaccuucgccaccgccaacgccgacacccucugcaucggcuaccacgccgacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccggccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccuccccccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96834 - RNA, 1701 nt, Artificial Sequence
  derived and/or modified sequence opt2 from hemagglutinin__InfluenzaA__ADK87313
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucgccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacugguuccucuggaucuccuucgccaucuccugcuuccuccucugcgucgcccuccucggcuucaucaugugggccugccagaagggcaacauccgcugcaacaucugcaucuga

SEQ ID NO: 96835 - RNA, 1701 nt, Artificial Sequence
  derived and/or modified sequence opt2 from hemagglutinin__InfluenzaA__ADK87315
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccucccccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguccaaccaccucgagacccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacuccaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96836 - RNA, 1701 nt, Artificial Sequence; identical to SEQ ID NO: 94979
  derived and/or modified sequence opt2 from hemagglutinin__InfluenzaA__ADK87317

SEQ ID NO: 96837 - RNA, 1701 nt, Artificial Sequence
  derived and/or modified sequence opt2 from hemagglutinin__InfluenzaA__ADK87319
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccgagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccgcauccucgccaucuacuccaccgucgccuccucccucguccucgucgucucccucggcgccaucuccuucuggaugugcuccaacggcucccuccagugccgcaucugcaucuga

SEQ ID NO: 96838 - RNA, 1701 nt, Artificial Sequence
  derived and/or modified sequence opt2 from hemagglutinin__InfluenzaA__ADK87321
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccgucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguuccccgaggucgagggccgcauccaggaccucgagaaguacgucgaggacaccaagaucgaccucugguccuacaacgccgagccccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacugguuccucuggaucuccuucgccaucuccugcuuccuccucugcgucgcccuccucggcuucaucaugugggccugccagaagggcaacauccgcugcaacaucugcaucuga

SEQ ID NO: 96839 - RNA, 1701 nt, Artificial Sequence
  derived and/or modified sequence opt2 from hemagglutinin__InfluenzaA__ADK87323
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcgucggcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96840 - RNA, 1701 nt, Artificial Sequence
  derived and/or modified sequence opt2 from hemagglutinin__InfluenzaA__ADK87325
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgccacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96841 - RNA, 1701 nt, Artificial Sequence
  derived and/or modified sequence opt2 from hemagglutinin__InfluenzaA__ADK87326
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcugcaaggacuggauccucuggaucuccuucgccaucuccugcuuccuccucugcgucgcccuccucggcuucaccaugugggccugccagaagggcaacauccgcugcaacaucugcaucuga

SEQ ID NO: 96842 - RNA, 1701 nt, Artificial Sequence
  derived and/or modified sequence opt2 from hemagglutinin__InfluenzaA__ADK87328
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaaguccgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96843 - RNA, 1701 nt, Artificial Sequence
  derived and/or modified sequence opt2 from hemagglutinin__InfluenzaA__ADK87334
augaagaccaucaucgcccucuccuacauccucugccucgucuucgcccagaagcuccccggcaacgacaacuccaccgccacccucugccucggccaccacgccguccccaacggcaccaucgucaagaccaucaccuccgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucuccaagcucaacuggcucacccaccucaacuucaaguaccccgcccucaacgucaccaugcccaacaacgagcaguucgacaagcucuacaucuggggcguccgccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaccuacuggaccaucgucaagcccggcgacauccuccucaucaacuccaccggcaaccucaucgccccccgcggcuacuucaagauccgcuccggcaaguccuccaucaugcgcuccgacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96844 - RNA, 1701 nt, Artificial Sequence
  derived and/or modified sequence opt2 from hemagglutinin__InfluenzaA__ADK87336
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucuccaagcucaacuggcucacccaccucaacuucaaguaccccgcccucaacgucaccaugcccaacaacgagcaguucgacaagcucuacaucuggggcguccaccaccccggcaccgaccgcgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacacccccaucggcaaguccaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgaggacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96845 - RNA, 1701 nt, Artificial Sequence; identical to SEQ ID NO: 94181
  derived and/or modified sequence opt2 from hemagglutinin__InfluenzaA__ADK87338

SEQ ID NO: 96846 - RNA, 1701 nt, Artificial Sequence
  derived and/or modified sequence opt2 from hemagglutinin__InfluenzaA__ADK90193
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggucguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96847 - RNA, 1701 nt, Artificial Sequence
  derived and/or modified sequence opt2 from hemagglutinin__InfluenzaA__ADK90194
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96848 - RNA, 1701 nt, Artificial Sequence
  derived and/or modified sequence opt2 from hemagglutinin__InfluenzaA__ADK90195
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96849 - RNA, 1701 nt, Artificial Sequence; identical to SEQ ID NO: 94168
  derived and/or modified sequence opt2 from hemagglutinin__InfluenzaA__ADK90196

SEQ ID NO: 96850 - RNA, 1701 nt, Artificial Sequence
  derived and/or modified sequence opt2 from hemagglutinin__InfluenzaA__ADK90197
augcgcgccauccucggcguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96851 - RNA, 1701 nt, Artificial Sequence
  derived and/or modified sequence opt2 from hemagglutinin__InfluenzaA__ADK90198
augaaggccauccucggcguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96852 - RNA, 1701 nt, Artificial Sequence; identical to SEQ ID NO: 94181
  derived and/or modified sequence opt2 from hemagglutinin__InfluenzaA__ADK90199

SEQ ID NO: 96853 - RNA, 1701 nt, Artificial Sequence
  derived and/or modified sequence opt2 from hemagglutinin__InfluenzaA__ADK90200
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucgccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccgucuacuccaccgucgccuccucccucguccucgucgucucccucggcgccaucuccuucuggaugugcuccaacggcucccuccagugccgcaucugcaucuga

SEQ ID NO: 96854 - RNA, 1701 nt, Artificial Sequence
  derived and/or modified sequence opt2 from hemagglutinin__InfluenzaA__ADK90201
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccguccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96855 - RNA, 1701 nt, Artificial Sequence
  derived and/or modified sequence opt2 from hemagglutinin__InfluenzaA__ADK90202
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagccccucuccaccgccuccuccugguccuacaucgucgagaccuccuccuccgacaacggcaccugcuaccccggcgacuucaucgacuacgaggagcuccgcgagcagcucuccuccgucuccuccuucgagcgccucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96856 - RNA, 1701 nt, Artificial Sequence; identical to SEQ ID NO: 94361
  derived and/or modified sequence opt2 from hemagglutinin__InfluenzaA__ADK90203

SEQ ID NO: 96857 - RNA, 1701 nt, Artificial Sequence; identical to SEQ ID NO: 95282
  derived and/or modified sequence opt2 from hemagglutinin__InfluenzaA__ADK90204

SEQ ID NO: 96858 - RNA, 1701 nt, Artificial Sequence
  derived and/or modified sequence opt2 from hemagglutinin__InfluenzaA__ADK94191
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96859 - RNA, 1701 nt, Artificial Sequence
  derived and/or modified sequence opt2 from hemagglutinin__InfluenzaA__ADK94202
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96860 - RNA, 1701 nt, Artificial Sequence; identical to SEQ ID NO: 93946
  derived and/or modified sequence opt2 from hemagglutinin__InfluenzaA__ADK94213

SEQ ID NO: 96861 - RNA, 1701 nt, Artificial Sequence; identical to SEQ ID NO: 95125
  derived and/or modified sequence opt2 from hemagglutinin__InfluenzaA__ADK94224

SEQ ID NO: 96862 - RNA, 1701 nt, Artificial Sequence
  derived and/or modified sequence opt2 from hemagglutinin__InfluenzaA__ADK94257
auggagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96863 - RNA, 1701 nt, Artificial Sequence
  derived and/or modified sequence opt2 from hemagglutinin__InfluenzaA__ADK94268
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96864 - RNA, 1701 nt, Artificial Sequence
  derived and/or modified sequence opt2 from hemagglutinin__InfluenzaA__ADK94279
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96865 - RNA, 1701 nt, Artificial Sequence; identical to SEQ ID NO: 95125
  derived and/or modified sequence opt2 from hemagglutinin__InfluenzaA__ADK94290

SEQ ID NO: 96866 - RNA, 1701 nt, Artificial Sequence; identical to SEQ ID NO: 95125
  derived and/or modified sequence opt2 from hemagglutinin__InfluenzaA__ADK94301

SEQ ID NO: 96867 - RNA, 1701 nt, Artificial Sequence
  derived and/or modified sequence opt2 from hemagglutinin__InfluenzaA__ADK94323
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96868 - RNA, 1701 nt, Artificial Sequence; identical to SEQ ID NO: 96858
  derived and/or modified sequence opt2 from hemagglutinin__InfluenzaA__ADK94441

SEQ ID NO: 96869 - RNA, 1701 nt, Artificial Sequence
  derived and/or modified sequence opt2 from hemagglutinin__InfluenzaA__ADK94476
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcgcccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96870 - RNA, 1701 nt, Artificial Sequence; identical to SEQ ID NO: 95125
  derived and/or modified sequence opt2 from hemagglutinin__InfluenzaA__ADK94487

SEQ ID NO: 96871 - RNA, 1701 nt, Artificial Sequence
  derived and/or modified sequence opt2 from hemagglutinin__InfluenzaA__ADK94498
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96872 - RNA, 1701 nt, Artificial Sequence
  derived and/or modified sequence opt2 from hemagglutinin__InfluenzaA__ADK94509
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96873 - RNA, 1701 nt, Artificial Sequence
  derived and/or modified sequence opt2 from hemagglutinin__InfluenzaA__ADK94520
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 96874 - RNA, 1701 nt, Artificial Sequence; identical to SEQ ID NO: 95125
  derived and/or modified sequence opt2 from hemagglutinin__InfluenzaA__ADK94531

SEQ ID NO: 96875 - RNA, 1701 nt, Artificial Sequence; identical to SEQ ID NO: 93946
  derived and/or modified sequence opt2 from hemagglutinin__InfluenzaA__ADK94542

SEQ ID NO: 96876 - RNA, 1701 nt, Artificial Sequence
  derived and/or modified sequence opt2 from hemagglutinin__InfluenzaA__ADK94553
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcaacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96877 - RNA, 1701 nt, Artificial Sequence; identical to SEQ ID NO: 95125
  derived and/or modified sequence opt2 from hemagglutinin__InfluenzaA__ADK94564

SEQ ID NO: 96878 - RNA, 1701 nt, Artificial Sequence
  derived and/or modified sequence opt2 from hemagglutinin__InfluenzaA__ADK98501
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgagaccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96879 - RNA, 1701 nt, Artificial Sequence
  derived and/or modified sequence opt2 from hemagglutinin__InfluenzaA__ADK98503
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgucgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96880 - RNA, 1701 nt, Artificial Sequence; identical to SEQ ID NO: 96863
  derived and/or modified sequence opt2 from hemagglutinin__InfluenzaA__ADK98623

SEQ ID NO: 96881 - RNA, 1701 nt, Artificial Sequence; identical to SEQ ID NO: 93946
  derived and/or modified sequence opt2 from hemagglutinin__InfluenzaA__ADK98634

SEQ ID NO: 96882 - RNA, 1701 nt, Artificial Sequence; identical to SEQ ID NO: 93946
  derived and/or modified sequence opt2 from hemagglutinin__InfluenzaA__ADK98645

SEQ ID NO: 96883 - RNA, 1701 nt, Artificial Sequence; identical to SEQ ID NO: 96809
  derived and/or modified sequence opt2 from hemagglutinin__InfluenzaA__ADK98656

SEQ ID NO: 96884 - RNA, 1701 nt, Artificial Sequence; identical to SEQ ID NO: 96876
  derived and/or modified sequence opt2 from hemagglutinin__InfluenzaA__ADK98667

SEQ ID NO: 96885 - RNA, 1701 nt, Artificial Sequence
  derived and/or modified sequence opt2 from hemagglutinin__InfluenzaA__ADK98678
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccagaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96886 - RNA, 1701 nt, Artificial Sequence; identical to SEQ ID NO: 93946
  derived and/or modified sequence opt2 from hemagglutinin__InfluenzaA__ADK98689

SEQ ID NO: 96887 - RNA, 1701 nt, Artificial Sequence; identical to SEQ ID NO: 93946
  derived and/or modified sequence opt2 from hemagglutinin__InfluenzaA__ADK98700

SEQ ID NO: 96888 - RNA, 1701 nt, Artificial Sequence; identical to SEQ ID NO: 93946
  derived and/or modified sequence opt2 from hemagglutinin__InfluenzaA__ADK98711

SEQ ID NO: 96889 - RNA, 1701 nt, Artificial Sequence
  derived and/or modified sequence opt2 from hemagglutinin__InfluenzaA__ADK98722
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagggcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96890 - RNA, 1701 nt, Artificial Sequence; identical to SEQ ID NO: 96863
  derived and/or modified sequence opt2 from hemagglutinin__InfluenzaA__ADK98733

SEQ ID NO: 96891 - RNA, 1701 nt, Artificial Sequence; identical to SEQ ID NO: 93946
  derived and/or modified sequence opt2 from hemagglutinin__InfluenzaA__ADK98744

SEQ ID NO: 96892 - RNA, 1701 nt, Artificial Sequence; identical to SEQ ID NO: 93946
  derived and/or modified sequence opt2 from hemagglutinin__InfluenzaA__ADK98777

SEQ ID NO: 96893 - RNA, 1701 nt, Artificial Sequence; identical to SEQ ID NO: 93946
  derived and/or modified sequence opt2 from hemagglutinin__InfluenzaA__ADK98788

SEQ ID NO: 96894 - RNA, 1701 nt, Artificial Sequence; identical to SEQ ID NO: 95125
  derived and/or modified sequence opt2 from hemagglutinin__InfluenzaA__ADK98799

SEQ ID NO: 96895 - RNA, 1701 nt, Artificial Sequence
  derived and/or modified sequence opt2 from hemagglutinin__InfluenzaA__ADK98810
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaccuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaaggaggucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96896 - RNA, 1701 nt, Artificial Sequence
  derived and/or modified sequence opt2 from hemagglutinin__InfluenzaA__ADK98821
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96897 - RNA, 1701 nt, Artificial Sequence; identical to SEQ ID NO: 93946
  derived and/or modified sequence opt2 from hemagglutinin__InfluenzaA__ADK98832

SEQ ID NO: 96898 - RNA, 1701 nt, Artificial Sequence; identical to SEQ ID NO: 96876
  derived and/or modified sequence opt2 from hemagglutinin__InfluenzaA__ADK98843

SEQ ID NO: 96899 - RNA, 1701 nt, Artificial Sequence
  derived and/or modified sequence opt2 from hemagglutinin__InfluenzaA__ADK98854
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagcccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96900 - RNA, 1701 nt, Artificial Sequence
  derived and/or modified sequence opt2 from hemagglutinin__InfluenzaA__ADK98865
augaagaccaucaucgcccucuccuacauccucugccucgucuucgcccagaagcuccccggcuccgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96901 - RNA, 1701 nt, Artificial Sequence
  derived and/or modified sequence opt2 from hemagglutinin__InfluenzaA__ADK98876
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacggccaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96902 - RNA, 1701 nt, Artificial Sequence; identical to SEQ ID NO: 96876
  derived and/or modified sequence opt2 from hemagglutinin__InfluenzaA__ADK98887

SEQ ID NO: 96903 - RNA, 1701 nt, Artificial Sequence; identical to SEQ ID NO: 93946
  derived and/or modified sequence opt2 from hemagglutinin__InfluenzaA__ADK98898

SEQ ID NO: 96904 - RNA, 1701 nt, Artificial Sequence
  derived and/or modified sequence opt2 from hemagglutinin__InfluenzaA__ADK98909
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96905 - RNA, 1701 nt, Artificial Sequence
  derived and/or modified sequence opt2 from hemagglutinin__InfluenzaA__ADK98920
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcggcaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96906 - RNA, 1701 nt, Artificial Sequence; identical to SEQ ID NO: 93946
  derived and/or modified sequence opt2 from hemagglutinin__InfluenzaA__ADK98931

SEQ ID NO: 96907 - RNA, 1701 nt, Artificial Sequence
  derived and/or modified sequence opt2 from hemagglutinin__InfluenzaA__ADK98942
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucaucuccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96908 - RNA, 1701 nt, Artificial Sequence
  derived and/or modified sequence opt2 from hemagglutinin__InfluenzaA__ADK98953
augaagaccaucaucgcccucuccuacaugcucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96909 - RNA, 1701 nt, Artificial Sequence; identical to SEQ ID NO: 93946
  derived and/or modified sequence opt2 from hemagglutinin__InfluenzaA__ADK98964

SEQ ID NO: 96910 - RNA, 1701 nt, Artificial Sequence; identical to SEQ ID NO: 96863
  derived and/or modified sequence opt2 from hemagglutinin__InfluenzaA__ADK98975

SEQ ID NO: 96911 - RNA, 1701 nt, Artificial Sequence; identical to SEQ ID NO: 96908
  derived and/or modified sequence opt2 from hemagglutinin__InfluenzaA__ADK98986

SEQ ID NO: 96912 - RNA, 1701 nt, Artificial Sequence; identical to SEQ ID NO: 95125
  derived and/or modified sequence opt2 from hemagglutinin__InfluenzaA__ADK98997

SEQ ID NO: 96913 - RNA, 1701 nt, Artificial Sequence; identical to SEQ ID NO: 96908
  derived and/or modified sequence opt2 from hemagglutinin__InfluenzaA__ADK99008

SEQ ID NO: 96914 - RNA, 1701 nt, Artificial Sequence
  derived and/or modified sequence opt2 from hemagglutinin__InfluenzaA__ADK99030
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcgcuucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96915 - RNA, 1701 nt, Artificial Sequence
  derived and/or modified sequence opt2 from hemagglutinin__InfluenzaA__ADK99041
augaagaccaucaucgcccucuccuacauccucugccucgucuucgcccagaagcuccccggcaacgacaacuccaccgccacccucugccucggccaccacgccguccccaacggcaccaucgucaagaccaucgccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96916 - RNA, 1701 nt, Artificial Sequence; identical to SEQ ID NO: 96863
  derived and/or modified sequence opt2 from hemagglutinin__InfluenzaA__ADK99063

SEQ ID NO: 96917 - RNA, 1701 nt, Artificial Sequence; identical to SEQ ID NO: 93946
  derived and/or modified sequence opt2 from hemagglutinin__InfluenzaA__ADK99085

SEQ ID NO: 96918 - RNA, 1701 nt, Artificial Sequence; identical to SEQ ID NO: 93946
  derived and/or modified sequence opt2 from hemagglutinin__InfluenzaA__ADK99096

SEQ ID NO: 96919 - RNA, 1701 nt, Artificial Sequence; identical to SEQ ID NO: 93946
  derived and/or modified sequence opt2 from hemagglutinin__InfluenzaA__ADK99107

SEQ ID NO: 96920 - RNA, 1701 nt, Artificial Sequence
  derived and/or modified sequence opt2 from hemagglutinin__InfluenzaA__ADK99118
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacaucccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcaacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96921 - RNA, 1701 nt, Artificial Sequence
  derived and/or modified sequence opt2 from hemagglutinin__InfluenzaA__ADK99129
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacaugaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcaacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96922 - RNA, 1701 nt, Artificial Sequence; identical to SEQ ID NO: 96863
  derived and/or modified sequence opt2 from hemagglutinin__InfluenzaA__ADK99140

SEQ ID NO: 96923 - RNA, 1701 nt, Artificial Sequence
  derived and/or modified sequence opt2 from hemagglutinin__InfluenzaA__ADK99151
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96924 - RNA, 1701 nt, Artificial Sequence; identical to SEQ ID NO: 96863
  derived and/or modified sequence opt2 from hemagglutinin__InfluenzaA__ADK99162

SEQ ID NO: 96925 - RNA, 1701 nt, Artificial Sequence
  derived and/or modified sequence opt2 from hemagglutinin__InfluenzaA__ADK99173
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucauccaguccuccuccaccggcgagaucugcgacuccccccaccagauccucgacggcgagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96926 - RNA, 1701 nt, Artificial Sequence
  derived and/or modified sequence opt2 from hemagglutinin__InfluenzaA__ADK99184
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96927 - RNA, 1701 nt, Artificial Sequence; identical to SEQ ID NO: 93946
  derived and/or modified sequence opt2 from hemagglutinin__InfluenzaA__ADK99195

SEQ ID NO: 96928 - RNA, 1701 nt, Artificial Sequence
  derived and/or modified sequence opt2 from hemagglutinin__InfluenzaA__ADK99206
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucucccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96929 - RNA, 1701 nt, Artificial Sequence; identical to SEQ ID NO: 96863
  derived and/or modified sequence opt2 from hemagglutinin__InfluenzaA__ADK99217

SEQ ID NO: 96930 - RNA, 1701 nt, Artificial Sequence; identical to SEQ ID NO: 96863
  derived and/or modified sequence opt2 from hemagglutinin__InfluenzaA__ADK99228

SEQ ID NO: 96931 - RNA, 1701 nt, Artificial Sequence
  derived and/or modified sequence opt2 from hemagglutinin__InfluenzaA__ADK99239
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96932 - RNA, 1701 nt, Artificial Sequence
  derived and/or modified sequence opt2 from hemagglutinin__InfluenzaA__ADK99250
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96933 - RNA, 1701 nt, Artificial Sequence; identical to SEQ ID NO: 96863
  derived and/or modified sequence opt2 from hemagglutinin__InfluenzaA__ADK99261

SEQ ID NO: 96934 - RNA, 1701 nt, Artificial Sequence
  derived and/or modified sequence opt2 from hemagglutinin__InfluenzaA__ADK99283
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagcgcuacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96935 - RNA, 1701 nt, Artificial Sequence
  derived and/or modified sequence opt2 from hemagglutinin__InfluenzaA__ADK99294
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccaggacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96936 - RNA, 1701 nt, Artificial Sequence; identical to SEQ ID NO: 93946
  derived and/or modified sequence opt2 from hemagglutinin__InfluenzaA__ADK99305

SEQ ID NO: 96937 - RNA, 1701 nt, Artificial Sequence; identical to SEQ ID NO: 93946
  derived and/or modified sequence opt2 from hemagglutinin__InfluenzaA__ADL27989

SEQ ID NO: 96938 - RNA, 1701 nt, Artificial Sequence
  derived and/or modified sequence opt2 from hemagglutinin__InfluenzaA__ADL28000
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccgagcgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96939 - RNA, 1701 nt, Artificial Sequence
  derived and/or modified sequence opt2 from hemagglutinin__InfluenzaA__ADL28011
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccacccgccgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96940 - RNA, 1701 nt, Artificial Sequence; identical to SEQ ID NO: 96863
  derived and/or modified sequence opt2 from hemagglutinin__InfluenzaA__ADL28022

SEQ ID NO: 96941 - RNA, 1701 nt, Artificial Sequence; identical to SEQ ID NO: 93946
  derived and/or modified sequence opt2 from hemagglutinin__InfluenzaA__ADL28033

SEQ ID NO: 96942 - RNA, 1701 nt, Artificial Sequence; identical to SEQ ID NO: 95125
  derived and/or modified sequence opt2 from hemagglutinin__InfluenzaA__ADL28044

SEQ ID NO: 96943 - RNA, 1701 nt, Artificial Sequence
  derived and/or modified sequence opt2 from hemagglutinin__InfluenzaA__ADL28055
augaagaccaucgucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96944 - RNA, 1701 nt, Artificial Sequence; identical to SEQ ID NO: 93946
  derived and/or modified sequence opt2 from hemagglutinin__InfluenzaA__ADL28066

SEQ ID NO: 96945 - RNA, 1701 nt, Artificial Sequence; identical to SEQ ID NO: 96863
  derived and/or modified sequence opt2 from hemagglutinin__InfluenzaA__ADL28077

SEQ ID NO: 96946 - RNA, 1701 nt, Artificial Sequence
  derived and/or modified sequence opt2 from hemagglutinin__InfluenzaA__ADL28088
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacucccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96947 - RNA, 1701 nt, Artificial Sequence; identical to SEQ ID NO: 93946
  derived and/or modified sequence opt2 from hemagglutinin__InfluenzaA__ADL28099

SEQ ID NO: 96948 - RNA, 1701 nt, Artificial Sequence
  derived and/or modified sequence opt2 from hemagglutinin__InfluenzaA__ADL28110
augaagaccaucaucgcccucuccuacauccucugccucgucuucgcccagaagcuccccggcaacgacaacuccaccgccacccucugcaucggccaccacgccguccccaacggcaccaucgucaagaccaucaccaacgaccagaucgaggucaccaacgccaccgagcucguccagaacuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96949 - RNA, 1701 nt, Artificial Sequence
  derived and/or modified sequence opt2 from hemagglutinin__InfluenzaA__ADL28126
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucaaccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96950 - RNA, 1701 nt, Artificial Sequence
  derived and/or modified sequence opt2 from hemagglutinin__InfluenzaA__ADL28137
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacggcccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96951 - RNA, 1701 nt, Artificial Sequence; identical to SEQ ID NO: 93946
  derived and/or modified sequence opt2 from hemagglutinin__InfluenzaA__ADL28148

SEQ ID NO: 96952 - RNA, 1701 nt, Artificial Sequence; identical to SEQ ID NO: 96863
  derived and/or modified sequence opt2 from hemagglutinin__InfluenzaA__ADL28170

SEQ ID NO: 96953 - RNA, 1701 nt, Artificial Sequence; identical to SEQ ID NO: 93946
  derived and/or modified sequence opt2 from hemagglutinin__InfluenzaA__ADL28181

SEQ ID NO: 96954 - RNA, 1701 nt, Artificial Sequence; identical to SEQ ID NO: 96858
  derived and/or modified sequence opt2 from hemagglutinin__InfluenzaA__ADL28192

SEQ ID NO: 96955 - RNA, 1701 nt, Artificial Sequence; identical to SEQ ID NO: 96864
  derived and/or modified sequence opt2 from hemagglutinin__InfluenzaA__ADL28203

SEQ ID NO: 96956 - RNA, 1701 nt, Artificial Sequence; identical to SEQ ID NO: 94923
  derived and/or modified sequence opt2 from hemagglutinin__InfluenzaA__ADL28214

SEQ ID NO: 96957 - RNA, 1701 nt, Artificial Sequence
  derived and/or modified sequence opt2 from hemagglutinin__InfluenzaA__ADL28225
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacucccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaccgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 96958 - RNA, 1701 nt, Artificial Sequence; identical to SEQ ID NO: 96863
  derived and/or modified sequence opt2 from hemagglutinin__InfluenzaA__ADL28236

SEQ ID NO: 96959 - RNA, 1701 nt, Artificial Sequence; identical to SEQ ID NO: 93946
  derived and/or modified sequence opt2 from hemagglutinin__InfluenzaA__ADL28247

SEQ ID NO: 96960 - RNA, 1701 nt, Artificial Sequence; identical to SEQ ID NO: 96876
  derived and/or modified sequence opt2 from hemagglutinin__InfluenzaA__ADL28258

SEQ ID NO: 96961 - RNA, 1701 nt, Artificial Sequence; identical to SEQ ID NO: 93946
  derived and/or modified sequence opt2 from hemagglutinin__InfluenzaA__ADL28370

SEQ ID NO: 96962 - RNA, 1701 nt, Artificial Sequence; identical to SEQ ID NO: 94181
  derived and/or modified sequence opt2 from hemagglutinin__InfluenzaA__ADL29672

SEQ ID NO: 96963 - RNA, 1701 nt, Artificial Sequence; identical to SEQ ID NO: 94423
  derived and/or modified sequence opt2 from hemagglutinin__InfluenzaA__ADL29682

SEQ ID NO: 96964 - RNA, 1701 nt, Artificial Sequence; identical to SEQ ID NO: 94181
  derived and/or modified sequence opt2 from hemagglutinin__InfluenzaA__ADL29692

SEQ ID NO: 96965 - RNA, 1701 nt, Artificial Sequence
  derived and/or modified sequence opt2 from hemagglutinin__InfluenzaA__ADL29702
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96966 - RNA, 1701 nt, Artificial Sequence; identical to SEQ ID NO: 94181
  derived and/or modified sequence opt2 from hemagglutinin__InfluenzaA__ADL29730

SEQ ID NO: 96967 - RNA, 1701 nt, Artificial Sequence; identical to SEQ ID NO: 94181
  derived and/or modified sequence opt2 from hemagglutinin__InfluenzaA__ADL29740

SEQ ID NO: 96968 - RNA, 1701 nt, Artificial Sequence; identical to SEQ ID NO: 94181
  derived and/or modified sequence opt2 from hemagglutinin__InfluenzaA__ADL29750

SEQ ID NO: 96969 - RNA, 1701 nt, Artificial Sequence
  derived and/or modified sequence opt2 from hemagglutinin__InfluenzaA__ADL29760
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaguacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96970 - RNA, 1701 nt, Artificial Sequence; identical to SEQ ID NO: 94181
  derived and/or modified sequence opt2 from hemagglutinin__InfluenzaA__ADL29770

SEQ ID NO: 96971 - RNA, 1701 nt, Artificial Sequence; identical to SEQ ID NO: 95681
  derived and/or modified sequence opt2 from hemagglutinin__InfluenzaA__ADL29780

SEQ ID NO: 96972 - RNA, 1701 nt, Artificial Sequence
  derived and/or modified sequence opt2 from hemagglutinin__InfluenzaA__ADL29879
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96973 - RNA, 1701 nt, Artificial Sequence
  derived and/or modified sequence opt2 from hemagglutinin__InfluenzaA__ADL32017
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96974 - RNA, 1701 nt, Artificial Sequence
  derived and/or modified sequence opt2 from hemagglutinin__InfluenzaA__ADL32037
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgucgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96975 - RNA, 1701 nt, Artificial Sequence; identical to SEQ ID NO: 94181
  derived and/or modified sequence opt2 from hemagglutinin__InfluenzaA__ADL32047

SEQ ID NO: 96976 - RNA, 1701 nt, Artificial Sequence
  derived and/or modified sequence opt2 from hemagglutinin__InfluenzaA__ADL32057
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaagggcaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96977 - RNA, 1701 nt, Artificial Sequence; identical to SEQ ID NO: 94181
  derived and/or modified sequence opt2 from hemagglutinin__InfluenzaA__ADL32090

SEQ ID NO: 96978 - RNA, 1701 nt, Artificial Sequence; identical to SEQ ID NO: 94181
  derived and/or modified sequence opt2 from hemagglutinin__InfluenzaA__ADL32114

SEQ ID NO: 96979 - RNA, 1701 nt, Artificial Sequence; identical to SEQ ID NO: 94181
  derived and/or modified sequence opt2 from hemagglutinin__InfluenzaA__ADL32344

SEQ ID NO: 96980 - RNA, 1701 nt, Artificial Sequence; identical to SEQ ID NO: 94628
  derived and/or modified sequence opt2 from hemagglutinin__InfluenzaA__ADL32354

SEQ ID NO: 96981 - RNA, 1701 nt, Artificial Sequence
  derived and/or modified sequence opt2 from hemagglutinin__InfluenzaA__ADL32364
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaucuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96982 - RNA, 1701 nt, Artificial Sequence; identical to SEQ ID NO: 94181
  derived and/or modified sequence opt2 from hemagglutinin__InfluenzaA__ADL32374

SEQ ID NO: 96983 - RNA, 1701 nt, Artificial Sequence
  derived and/or modified sequence opt2 from hemagglutinin__InfluenzaA__ADL32384
augaaggccauccucgucguccuccucuacaccuucgccaccgccaccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96984 - RNA, 1701 nt, Artificial Sequence
  derived and/or modified sequence opt2 from hemagglutinin__InfluenzaA__ADL32394
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96985 - RNA, 1701 nt, Artificial Sequence; identical to SEQ ID NO: 94181
  derived and/or modified sequence opt2 from hemagglutinin__InfluenzaA__ADL32404

SEQ ID NO: 96986 - RNA, 1701 nt, Artificial Sequence
  derived and/or modified sequence opt2 from hemagglutinin__InfluenzaA__ADL32414
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgcccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96987 - RNA, 1701 nt, Artificial Sequence
  derived and/or modified sequence opt2 from hemagglutinin__InfluenzaA__ADL32424
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96988 - RNA, 1701 nt, Artificial Sequence
  derived and/or modified sequence opt2 from hemagglutinin__InfluenzaA__ADL32434
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccauccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggauccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96989 - RNA, 1701 nt, Artificial Sequence; identical to SEQ ID NO: 95601
  derived and/or modified sequence opt2 from hemagglutinin__InfluenzaA__ADL32444

SEQ ID NO: 96990 - RNA, 1701 nt, Artificial Sequence
  derived and/or modified sequence opt2 from hemagglutinin__InfluenzaA__ADL32454
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagcucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96991 - RNA, 1701 nt, Artificial Sequence; identical to SEQ ID NO: 96348
  derived and/or modified sequence opt2 from hemagglutinin__InfluenzaA__ADL32464

SEQ ID NO: 96992 - RNA, 1701 nt, Artificial Sequence; identical to SEQ ID NO: 96348
  derived and/or modified sequence opt2 from hemagglutinin__InfluenzaA__ADL32484

SEQ ID NO: 96993 - RNA, 1701 nt, Artificial Sequence
  derived and/or modified sequence opt2 from hemagglutinin__InfluenzaA__ADL32504
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaugugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96994 - RNA, 1701 nt, Artificial Sequence; identical to SEQ ID NO: 95601
  derived and/or modified sequence opt2 from hemagglutinin__InfluenzaA__ADL32514

SEQ ID NO: 96995 - RNA, 1701 nt, Artificial Sequence; identical to SEQ ID NO: 96348
  derived and/or modified sequence opt2 from hemagglutinin__InfluenzaA__ADL32524

SEQ ID NO: 96996 - RNA, 1701 nt, Artificial Sequence
  derived and/or modified sequence opt2 from hemagglutinin__InfluenzaA__ADL32544
augaaggccauccucgucguccuccucuacaccuucgccaccuccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgcaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 96997 - RNA, 1701 nt, Artificial Sequence; identical to SEQ ID NO: 96782
  derived and/or modified sequence opt2 from hemagglutinin__InfluenzaA__ADL32554

SEQ ID NO: 96998 - RNA, 1701 nt, Artificial Sequence; identical to SEQ ID NO: 95794
  derived and/or modified sequence opt2 from hemagglutinin__InfluenzaA__ADL32670

SEQ ID NO: 96999 - RNA, 1701 nt, Artificial Sequence
  derived and/or modified sequence opt2 from hemagglutinin__InfluenzaA__ADL32690
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucauguggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97000 - RNA, 1701 nt, Artificial Sequence; identical to SEQ ID NO: 94361
  derived and/or modified sequence opt2 from hemagglutinin__InfluenzaA__ADL32710

SEQ ID NO: 97001 - RNA, 1701 nt, Artificial Sequence; identical to SEQ ID NO: 94181
  derived and/or modified sequence opt2 from hemagglutinin__InfluenzaA__ADL32720

SEQ ID NO: 97002 - RNA, 1701 nt, Artificial Sequence; identical to SEQ ID NO: 95953
  derived and/or modified sequence opt2 from hemagglutinin__InfluenzaA__ADL32730

SEQ ID NO: 97003 - RNA, 1701 nt, Artificial Sequence; identical to SEQ ID NO: 95953
  derived and/or modified sequence opt2 from hemagglutinin__InfluenzaA__ADL32740

SEQ ID NO: 97004 - RNA, 1701 nt, Artificial Sequence; identical to SEQ ID NO: 95125
  derived and/or modified sequence opt2 from hemagglutinin__InfluenzaA__ADL39137

SEQ ID NO: 97005 - RNA, 1698 nt, Artificial Sequence
  derived and/or modified sequence opt2 from hemagglutinin__InfluenzaA__ADL39148
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcgacuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97006 - RNA, 1701 nt, Artificial Sequence
  derived and/or modified sequence opt2 from hemagglutinin__InfluenzaA__ADL39159
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcauccgcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcuucgcccuccucggcuucaucaugugggccugccagaagggcaacauccgcugcaacaucugcaucuga

SEQ ID NO: 97007 - RNA, 1701 nt, Artificial Sequence
  derived and/or modified sequence opt2 from hemagglutinin__InfluenzaA__ADL39170
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccguccccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacguccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97008 - RNA, 1701 nt, Artificial Sequence; identical to SEQ ID NO: 95125
  derived and/or modified sequence opt2 from hemagglutinin__InfluenzaA__ADL39203

SEQ ID NO: 97009 - RNA, 1701 nt, Artificial Sequence; identical to SEQ ID NO: 93946
  derived and/or modified sequence opt2 from hemagglutinin__InfluenzaA__ADL39214

SEQ ID NO: 97010 - RNA, 1698 nt, Artificial Sequence
  derived and/or modified sequence opt2 from hemagglutinin__InfluenzaA__ADL39225
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97011 - RNA, 1698 nt, Artificial Sequence
  derived and/or modified sequence opt2 from hemagglutinin__InfluenzaA__ADL39236
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacaccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97012 - RNA, 1701 nt, Artificial Sequence
  derived and/or modified sequence opt2 from hemagglutinin__InfluenzaA__ADL39280
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97013 - RNA, 1698 nt, Artificial Sequence
  derived and/or modified sequence opt2 from hemagglutinin__InfluenzaA__ADL39291
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccaacaugggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97014 - RNA, 1701 nt, Artificial Sequence; identical to SEQ ID NO: 93946
  derived and/or modified sequence opt2 from hemagglutinin__InfluenzaA__ADL39302

SEQ ID NO: 97015 - RNA, 1701 nt, Artificial Sequence; identical to SEQ ID NO: 97012
  derived and/or modified sequence opt2 from hemagglutinin__InfluenzaA__ADL39313

SEQ ID NO: 97016 - RNA, 1701 nt, Artificial Sequence
  derived and/or modified sequence opt2 from hemagglutinin__InfluenzaA__ADL39335
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97017 - RNA, 1701 nt, Artificial Sequence; identical to SEQ ID NO: 93946
  derived and/or modified sequence opt2 from hemagglutinin__InfluenzaA__ADL39368

SEQ ID NO: 97018 - RNA, 1698 nt, Artificial Sequence
  derived and/or modified sequence opt2 from hemagglutinin__InfluenzaA__ADL39390
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccucccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97019 - RNA, 1701 nt, Artificial Sequence
  derived and/or modified sequence opt2 from hemagglutinin__InfluenzaA__ADL39401
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaugcgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97020 - RNA, 1701 nt, Artificial Sequence
  derived and/or modified sequence opt2 from hemagglutinin__InfluenzaA__ADL39412
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccgagaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97021 - RNA, 1698 nt, Artificial Sequence
  derived and/or modified sequence opt2 from hemagglutinin__InfluenzaA__ADL39423
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccucccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97022 - RNA, 1701 nt, Artificial Sequence
  derived and/or modified sequence opt2 from hemagglutinin__InfluenzaA__ADL39434
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97023 - RNA, 1698 nt, Artificial Sequence
  derived and/or modified sequence opt2 from hemagglutinin__InfluenzaA__ADL39445
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccacccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97024 - RNA, 1698 nt, Artificial Sequence
  derived and/or modified sequence opt2 from hemagglutinin__InfluenzaA__ADL39456
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccucccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97025 - RNA, 1698 nt, Artificial Sequence
  derived and/or modified sequence opt2 from hemagglutinin__InfluenzaA__ADL39467
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97026 - RNA, 1701 nt, Artificial Sequence; identical to SEQ ID NO: 94181
  derived and/or modified sequence opt2 from hemagglutinin__InfluenzaA__ADL41164

SEQ ID NO: 97027 - RNA, 1701 nt, Artificial Sequence; identical to SEQ ID NO: 94274
  derived and/or modified sequence opt2 from hemagglutinin__InfluenzaA__ADL41173

SEQ ID NO: 97028 - RNA, 1698 nt, Artificial Sequence
  derived and/or modified sequence opt2 from hemagglutinin__InfluenzaA__ADL60242
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccgacaucggcaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97029 - RNA, 1698 nt, Artificial Sequence
  derived and/or modified sequence opt2 from hemagglutinin__InfluenzaA__ADL60253
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcggccuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97030 - RNA, 1698 nt, Artificial Sequence; identical to SEQ ID NO: 97028
  derived and/or modified sequence opt2 from hemagglutinin__InfluenzaA__ADL60264

SEQ ID NO: 97031 - RNA, 1698 nt, Artificial Sequence; identical to SEQ ID NO: 97028
  derived and/or modified sequence opt2 from hemagglutinin__InfluenzaA__ADL60275

SEQ ID NO: 97032 - RNA, 1698 nt, Artificial Sequence
  derived and/or modified sequence opt2 from hemagglutinin__InfluenzaA__ADL60286
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccaaccagaagacccucuaccacaccgagaacgccuacgucuccgucgucuccucccacuacucccgcaaguucacccccgaggucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97033 - RNA, 1698 nt, Artificial Sequence
  derived and/or modified sequence opt2 from hemagglutinin__InfluenzaA__ADL60297
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucacccgcaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacucccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97034 - RNA, 1698 nt, Artificial Sequence
  derived and/or modified sequence opt2 from hemagglutinin__InfluenzaA__ADL60308
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97035 - RNA, 1698 nt, Artificial Sequence
  derived and/or modified sequence opt2 from hemagglutinin__InfluenzaA__ADL60341
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaaggcccucuaccacaccgagaucgccuacgucuccgucgucuccucccacuacucccgcaaguucacccccgagaucgccaagcgccccaagguccgcgaccaggagggccgcaucaacuacuacuggaccauccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97036 - RNA, 1698 nt, Artificial Sequence
  derived and/or modified sequence opt2 from hemagglutinin__InfluenzaA__ADL60352
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccggcuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccgacaucggcaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97037 - RNA, 1701 nt, Artificial Sequence
  derived and/or modified sequence opt2 from hemagglutinin__InfluenzaA__ADL60363
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccaucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcgucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 97038 - RNA, 1698 nt, Artificial Sequence
  derived and/or modified sequence opt2 from hemagglutinin__InfluenzaA__ADL60374
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacgacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcgucgucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97039 - RNA, 1701 nt, Artificial Sequence
  derived and/or modified sequence opt2 from hemagglutinin__InfluenzaA__ADM07135
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97040 - RNA, 1701 nt, Artificial Sequence; identical to SEQ ID NO: 94666
  derived and/or modified sequence opt2 from hemagglutinin__InfluenzaA__ADM07144

SEQ ID NO: 97041 - RNA, 1701 nt, Artificial Sequence
  derived and/or modified sequence opt2 from hemagglutinin__InfluenzaA__ADM07154
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97042 - RNA, 1701 nt, Artificial Sequence; identical to SEQ ID NO: 94666
  derived and/or modified sequence opt2 from hemagglutinin__InfluenzaA__ADM07163

SEQ ID NO: 97043 - RNA, 1698 nt, Artificial Sequence; identical to SEQ ID NO: 97025
  derived and/or modified sequence opt2 from hemagglutinin__InfluenzaA__ADM07460

SEQ ID NO: 97044 - RNA, 1701 nt, Artificial Sequence
  derived and/or modified sequence opt2 from hemagglutinin__InfluenzaA__ADM07504
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97045 - RNA, 1701 nt, Artificial Sequence
  derived and/or modified sequence opt2 from hemagglutinin__InfluenzaA__ADM12806
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97046 - RNA, 1701 nt, Artificial Sequence; identical to SEQ ID NO: 97045
  derived and/or modified sequence opt2 from hemagglutinin__InfluenzaA__ADM12817

SEQ ID NO: 97047 - RNA, 1701 nt, Artificial Sequence; identical to SEQ ID NO: 97045
  derived and/or modified sequence opt2 from hemagglutinin__InfluenzaA__ADM12828

SEQ ID NO: 97048 - RNA, 1701 nt, Artificial Sequence; identical to SEQ ID NO: 97045
  derived and/or modified sequence opt2 from hemagglutinin__InfluenzaA__ADM12839

SEQ ID NO: 97049 - RNA, 1701 nt, Artificial Sequence
  derived and/or modified sequence opt2 from hemagglutinin__InfluenzaA__ADM12850
augaaggccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97050 - RNA, 1701 nt, Artificial Sequence; identical to SEQ ID NO: 94181
  derived and/or modified sequence opt2 from hemagglutinin__InfluenzaA__ADM12861

SEQ ID NO: 97051 - RNA, 1701 nt, Artificial Sequence; identical to SEQ ID NO: 94181
  derived and/or modified sequence opt2 from hemagglutinin__InfluenzaA__ADM12871

SEQ ID NO: 97052 - RNA, 1701 nt, Artificial Sequence; identical to SEQ ID NO: 94181
  derived and/or modified sequence opt2 from hemagglutinin__InfluenzaA__ADM12881

SEQ ID NO: 97053 - RNA, 1701 nt, Artificial Sequence; identical to SEQ ID NO: 94181
  derived and/or modified sequence opt2 from hemagglutinin__InfluenzaA__ADM12891

SEQ ID NO: 97054 - RNA, 1701 nt, Artificial Sequence; identical to SEQ ID NO: 94181
  derived and/or modified sequence opt2 from hemagglutinin__InfluenzaA__ADM12901

SEQ ID NO: 97055 - RNA, 1701 nt, Artificial Sequence; identical to SEQ ID NO: 95283
  derived and/or modified sequence opt2 from hemagglutinin__InfluenzaA__ADM12911

SEQ ID NO: 97056 - RNA, 1701 nt, Artificial Sequence; identical to SEQ ID NO: 94181
  derived and/or modified sequence opt2 from hemagglutinin__InfluenzaA__ADM12921

SEQ ID NO: 97057 - RNA, 1701 nt, Artificial Sequence; identical to SEQ ID NO: 94181
  derived and/or modified sequence opt2 from hemagglutinin__InfluenzaA__ADM12931

SEQ ID NO: 97058 - RNA, 1701 nt, Artificial Sequence; identical to SEQ ID NO: 94181
  derived and/or modified sequence opt2 from hemagglutinin__InfluenzaA__ADM12941

SEQ ID NO: 97059 - RNA, 1701 nt, Artificial Sequence; identical to SEQ ID NO: 94181
  derived and/or modified sequence opt2 from hemagglutinin__InfluenzaA__ADM12951

SEQ ID NO: 97060 - RNA, 1701 nt, Artificial Sequence
  derived and/or modified sequence opt2 from hemagglutinin__InfluenzaA__ADM12961
augaaggccguccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97061 - RNA, 1701 nt, Artificial Sequence; identical to SEQ ID NO: 95830
  derived and/or modified sequence opt2 from hemagglutinin__InfluenzaA__ADM12971

SEQ ID NO: 97062 - RNA, 1701 nt, Artificial Sequence; identical to SEQ ID NO: 95282
  derived and/or modified sequence opt2 from hemagglutinin__InfluenzaA__ADM12981

SEQ ID NO: 97063 - RNA, 1701 nt, Artificial Sequence
  derived and/or modified sequence opt2 from hemagglutinin__InfluenzaA__ADM12991
augaaggccauccucgucguccuccucuacaccuucgagaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97064 - RNA, 1701 nt, Artificial Sequence
  derived and/or modified sequence opt2 from hemagglutinin__InfluenzaA__ADM13001
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97065 - RNA, 1701 nt, Artificial Sequence; identical to SEQ ID NO: 95345
  derived and/or modified sequence opt2 from hemagglutinin__InfluenzaA__ADM13011

SEQ ID NO: 97066 - RNA, 1701 nt, Artificial Sequence
  derived and/or modified sequence opt2 from hemagglutinin__InfluenzaA__ADM13021
augaaggccauccucgucguccuccucuacaccuucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97067 - RNA, 1701 nt, Artificial Sequence; identical to SEQ ID NO: 95527
  derived and/or modified sequence opt2 from hemagglutinin__InfluenzaA__ADM13031

SEQ ID NO: 97068 - RNA, 1701 nt, Artificial Sequence
  derived and/or modified sequence opt2 from hemagglutinin__InfluenzaA__ADM13041
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97069 - RNA, 1701 nt, Artificial Sequence
  derived and/or modified sequence opt2 from hemagglutinin__InfluenzaA__ADM13051
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97070 - RNA, 1701 nt, Artificial Sequence
  derived and/or modified sequence opt2 from hemagglutinin__InfluenzaA__ADM13061
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccuccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97071 - RNA, 1701 nt, Artificial Sequence; identical to SEQ ID NO: 96348
  derived and/or modified sequence opt2 from hemagglutinin__InfluenzaA__ADM13071

SEQ ID NO: 97072 - RNA, 1701 nt, Artificial Sequence
  derived and/or modified sequence opt2 from hemagglutinin__InfluenzaA__ADM13081
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97073 - RNA, 1701 nt, Artificial Sequence; identical to SEQ ID NO: 95601
  derived and/or modified sequence opt2 from hemagglutinin__InfluenzaA__ADM13091

SEQ ID NO: 97074 - RNA, 1701 nt, Artificial Sequence; identical to SEQ ID NO: 95345
  derived and/or modified sequence opt2 from hemagglutinin__InfluenzaA__ADM13101

SEQ ID NO: 97075 - RNA, 1701 nt, Artificial Sequence
  derived and/or modified sequence opt2 from hemagglutinin__InfluenzaA__ADM13111
augaaggccauccucgucguccuccucuacaccuucgagaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgaccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97076 - RNA, 1701 nt, Artificial Sequence; identical to SEQ ID NO: 94181
  derived and/or modified sequence opt2 from hemagglutinin__InfluenzaA__ADM13121

SEQ ID NO: 97077 - RNA, 1701 nt, Artificial Sequence; identical to SEQ ID NO: 95345
  derived and/or modified sequence opt2 from hemagglutinin__InfluenzaA__ADM13131

SEQ ID NO: 97078 - RNA, 1701 nt, Artificial Sequence; identical to SEQ ID NO: 95509
  derived and/or modified sequence opt2 from hemagglutinin__InfluenzaA__ADM13141

SEQ ID NO: 97079 - RNA, 1701 nt, Artificial Sequence; identical to SEQ ID NO: 95509
  derived and/or modified sequence opt2 from hemagglutinin__InfluenzaA__ADM13151

SEQ ID NO: 97080 - RNA, 1701 nt, Artificial Sequence; identical to SEQ ID NO: 95282
  derived and/or modified sequence opt2 from hemagglutinin__InfluenzaA__ADM13161

SEQ ID NO: 97081 - RNA, 1701 nt, Artificial Sequence; identical to SEQ ID NO: 95830
  derived and/or modified sequence opt2 from hemagglutinin__InfluenzaA__ADM13171

SEQ ID NO: 97082 - RNA, 1701 nt, Artificial Sequence; identical to SEQ ID NO: 95830
  derived and/or modified sequence opt2 from hemagglutinin__InfluenzaA__ADM13181

SEQ ID NO: 97083 - RNA, 1701 nt, Artificial Sequence
  derived and/or modified sequence opt2 from hemagglutinin__InfluenzaA__ADM13191
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97084 - RNA, 1701 nt, Artificial Sequence
  derived and/or modified sequence opt2 from hemagglutinin__InfluenzaA__ADM13211
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97085 - RNA, 1701 nt, Artificial Sequence; identical to SEQ ID NO: 97084
  derived and/or modified sequence opt2 from hemagglutinin__InfluenzaA__ADM13221

SEQ ID NO: 97086 - RNA, 1701 nt, Artificial Sequence
  derived and/or modified sequence opt2 from hemagglutinin__InfluenzaA__ADM13231
augaaggccauccucgucguccuccucuacaccuucgagaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97087 - RNA, 1701 nt, Artificial Sequence; identical to SEQ ID NO: 95345
  derived and/or modified sequence opt2 from hemagglutinin__InfluenzaA__ADM13241

SEQ ID NO: 97088 - RNA, 1701 nt, Artificial Sequence
  derived and/or modified sequence opt2 from hemagglutinin__InfluenzaA__ADM13251
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97089 - RNA, 1701 nt, Artificial Sequence
  derived and/or modified sequence opt2 from hemagglutinin__InfluenzaA__ADM13261
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97090 - RNA, 1701 nt, Artificial Sequence
  derived and/or modified sequence opt2 from hemagglutinin__InfluenzaA__ADM13271
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcauccaccagauccucgccaucuacuccaccgucgccuccucccucguccucgucgucucccucggcgccaucuccuucuggaugugcuccaacggcucccuccagugccgcaucugcaucuga

SEQ ID NO: 97091 - RNA, 1701 nt, Artificial Sequence; identical to SEQ ID NO: 97086
  derived and/or modified sequence opt2 from hemagglutinin__InfluenzaA__ADM13281

SEQ ID NO: 97092 - RNA, 1701 nt, Artificial Sequence; identical to SEQ ID NO: 95282
  derived and/or modified sequence opt2 from hemagglutinin__InfluenzaA__ADM13291

SEQ ID NO: 97093 - RNA, 1701 nt, Artificial Sequence
  derived and/or modified sequence opt2 from hemagglutinin__InfluenzaA__ADM13301
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgucgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97094 - RNA, 1701 nt, Artificial Sequence
  derived and/or modified sequence opt2 from hemagglutinin__InfluenzaA__ADM13311
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgagaacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97095 - RNA, 1701 nt, Artificial Sequence; identical to SEQ ID NO: 95345
  derived and/or modified sequence opt2 from hemagglutinin__InfluenzaA__ADM13321

SEQ ID NO: 97096 - RNA, 1701 nt, Artificial Sequence
  derived and/or modified sequence opt2 from hemagglutinin__InfluenzaA__ADM13331
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97097 - RNA, 1701 nt, Artificial Sequence; identical to SEQ ID NO: 95794
  derived and/or modified sequence opt2 from hemagglutinin__InfluenzaA__ADM13341

SEQ ID NO: 97098 - RNA, 1701 nt, Artificial Sequence; identical to SEQ ID NO: 96760
  derived and/or modified sequence opt2 from hemagglutinin__InfluenzaA__ADM13351

SEQ ID NO: 97099 - RNA, 1701 nt, Artificial Sequence; identical to SEQ ID NO: 93841
  derived and/or modified sequence opt2 from hemagglutinin__InfluenzaA__ADM13442

SEQ ID NO: 97100 - RNA, 1701 nt, Artificial Sequence; identical to SEQ ID NO: 93841
  derived and/or modified sequence opt2 from hemagglutinin__InfluenzaA__ADM13443

SEQ ID NO: 97101 - RNA, 1701 nt, Artificial Sequence; identical to SEQ ID NO: 93841
  derived and/or modified sequence opt2 from hemagglutinin__InfluenzaA__ADM13444

SEQ ID NO: 97102 - RNA, 1701 nt, Artificial Sequence; identical to SEQ ID NO: 94788
  derived and/or modified sequence opt2 from hemagglutinin__InfluenzaA__ADM13445

SEQ ID NO: 97103 - RNA, 1701 nt, Artificial Sequence; identical to SEQ ID NO: 93841
  derived and/or modified sequence opt2 from hemagglutinin__InfluenzaA__ADM13446

SEQ ID NO: 97104 - RNA, 1701 nt, Artificial Sequence
  derived and/or modified sequence opt2 from hemagglutinin__InfluenzaA__ADM13447
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuacuccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 97105 - RNA, 1701 nt, Artificial Sequence; identical to SEQ ID NO: 93911
  derived and/or modified sequence opt2 from hemagglutinin__InfluenzaA__ADM13448

SEQ ID NO: 97106 - RNA, 1701 nt, Artificial Sequence
  derived and/or modified sequence opt2 from hemagglutinin__InfluenzaA__ADM13449
augaagaccaucaucgcccucuccuacaucuucugccucgccuucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaaccccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 97107 - RNA, 1701 nt, Artificial Sequence; identical to SEQ ID NO: 93943
  derived and/or modified sequence opt2 from hemagglutinin__InfluenzaA__ADM13450

SEQ ID NO: 97108 - RNA, 1701 nt, Artificial Sequence
  derived and/or modified sequence opt2 from hemagglutinin__InfluenzaA__ADM13451
augaagaccaucaucgcccucuccuacaucuucugccucgcccucggccaggaccuccccggcaacgacaaccgcaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccaccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 97109 - RNA, 1701 nt, Artificial Sequence; identical to SEQ ID NO: 93828
  derived and/or modified sequence opt2 from hemagglutinin__InfluenzaA__ADM13452

SEQ ID NO: 97110 - RNA, 1701 nt, Artificial Sequence
  derived and/or modified sequence opt2 from hemagglutinin__InfluenzaA__ADM14467
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccaguccauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97111 - RNA, 1695 nt, Artificial Sequence
  derived and/or modified sequence opt2 from hemagglutinin__InfluenzaA__ADM14516
augaaggccauccucgucguccuccucuacaccuucgccaccgccaacgccgacacccucugcaucggcuaccacgccaacaacuccaccgacaccgucaacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97112 - RNA, 1701 nt, Artificial Sequence
  derived and/or modified sequence opt2 from hemagglutinin__InfluenzaA__ADM14525
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccucccucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggacguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97113 - RNA, 1695 nt, Artificial Sequence
  derived and/or modified sequence opt2 from hemagglutinin__InfluenzaA__ADM14553
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucgagaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97114 - RNA, 1701 nt, Artificial Sequence; identical to SEQ ID NO: 94628
  derived and/or modified sequence opt2 from hemagglutinin__InfluenzaA__ADM14562

SEQ ID NO: 97115 - RNA, 1701 nt, Artificial Sequence; identical to SEQ ID NO: 94181
  derived and/or modified sequence opt2 from hemagglutinin__InfluenzaA__ADM14571

SEQ ID NO: 97116 - RNA, 1701 nt, Artificial Sequence
  derived and/or modified sequence opt2 from hemagglutinin__InfluenzaA__ADM14580
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97117 - RNA, 1701 nt, Artificial Sequence
  derived and/or modified sequence opt2 from hemagglutinin__InfluenzaA__ADM14589
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacggccagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97118 - RNA, 1701 nt, Artificial Sequence
  derived and/or modified sequence opt2 from hemagglutinin__InfluenzaA__ADM14599
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgucauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97119 - RNA, 1701 nt, Artificial Sequence; identical to SEQ ID NO: 95341
  derived and/or modified sequence opt2 from hemagglutinin__InfluenzaA__ADM14609

SEQ ID NO: 97120 - RNA, 1701 nt, Artificial Sequence
  derived and/or modified sequence opt2 from hemagglutinin__InfluenzaA__ADM14618
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacaaccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97121 - RNA, 1701 nt, Artificial Sequence; identical to SEQ ID NO: 94181
  derived and/or modified sequence opt2 from hemagglutinin__InfluenzaA__ADM14627

SEQ ID NO: 97122 - RNA, 1701 nt, Artificial Sequence
  derived and/or modified sequence opt2 from hemagglutinin__InfluenzaA__ADM14655
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacguccgcuccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97123 - RNA, 1701 nt, Artificial Sequence
  derived and/or modified sequence opt2 from hemagglutinin__InfluenzaA__ADM14664
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97124 - RNA, 1701 nt, Artificial Sequence; identical to SEQ ID NO: 94181
  derived and/or modified sequence opt2 from hemagglutinin__InfluenzaA__ADM14673

SEQ ID NO: 97125 - RNA, 1701 nt, Artificial Sequence; identical to SEQ ID NO: 94181
  derived and/or modified sequence opt2 from hemagglutinin__InfluenzaA__ADM14682

SEQ ID NO: 97126 - RNA, 1701 nt, Artificial Sequence; identical to SEQ ID NO: 94181
  derived and/or modified sequence opt2 from hemagglutinin__InfluenzaA__ADM14691

SEQ ID NO: 97127 - RNA, 1701 nt, Artificial Sequence; identical to SEQ ID NO: 95345
  derived and/or modified sequence opt2 from hemagglutinin__InfluenzaA__ADM14700

SEQ ID NO: 97128 - RNA, 1695 nt, Artificial Sequence
  derived and/or modified sequence opt2 from hemagglutinin__InfluenzaA__ADM14709
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucaacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97129 - RNA, 1701 nt, Artificial Sequence
  derived and/or modified sequence opt2 from hemagglutinin__InfluenzaA__ADM14718
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccauguccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97130 - RNA, 1695 nt, Artificial Sequence
  derived and/or modified sequence opt2 from hemagglutinin__InfluenzaA__ADM14728
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaacuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97131 - RNA, 1701 nt, Artificial Sequence
  derived and/or modified sequence opt2 from hemagglutinin__InfluenzaA__ADM14737
augaaggccauccucgucguccuccucuacaccuucgccaccgccaacgccgacacccucugcaucggcuaccacgccaacaacuccaccgacaccgucaacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97132 - RNA, 1701 nt, Artificial Sequence
  derived and/or modified sequence opt2 from hemagglutinin__InfluenzaA__ADM14746
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggguccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaagaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97133 - RNA, 1695 nt, Artificial Sequence
  derived and/or modified sequence opt2 from hemagglutinin__InfluenzaA__ADM14756
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97134 - RNA, 1701 nt, Artificial Sequence; identical to SEQ ID NO: 95345
  derived and/or modified sequence opt2 from hemagglutinin__InfluenzaA__ADM14765

SEQ ID NO: 97135 - RNA, 1695 nt, Artificial Sequence
  derived and/or modified sequence opt2 from hemagglutinin__InfluenzaA__ADM14775
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97136 - RNA, 1695 nt, Artificial Sequence
  derived and/or modified sequence opt2 from hemagglutinin__InfluenzaA__ADM14802
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagauccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97137 - RNA, 1704 nt, Artificial Sequence
  derived and/or modified sequence opt2 from hemagglutinin__InfluenzaA__ADM14830
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccuccagugccgcaucugcaucuga

SEQ ID NO: 97138 - RNA, 1695 nt, Artificial Sequence
  derived and/or modified sequence opt2 from hemagglutinin__InfluenzaA__ADM14848
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97139 - RNA, 1695 nt, Artificial Sequence
  derived and/or modified sequence opt2 from hemagglutinin__InfluenzaA__ADM14866
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaucaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97140 - RNA, 1695 nt, Artificial Sequence
  derived and/or modified sequence opt2 from hemagglutinin__InfluenzaA__ADM14876
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97141 - RNA, 1704 nt, Artificial Sequence
  derived and/or modified sequence opt2 from hemagglutinin__InfluenzaA__ADM14885
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgucauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacggcucccuccagugccgcaucugcaucuga

SEQ ID NO: 97142 - RNA, 1695 nt, Artificial Sequence
  derived and/or modified sequence opt2 from hemagglutinin__InfluenzaA__ADM14894
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgucauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcaugaaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97143 - RNA, 1695 nt, Artificial Sequence
  derived and/or modified sequence opt2 from hemagglutinin__InfluenzaA__ADM14903
augaaggccauccucgucguccuccucugcaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97144 - RNA, 1695 nt, Artificial Sequence
  derived and/or modified sequence opt2 from hemagglutinin__InfluenzaA__ADM14912
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97145 - RNA, 1695 nt, Artificial Sequence
  derived and/or modified sequence opt2 from hemagglutinin__InfluenzaA__ADM14921
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97146 - RNA, 1701 nt, Artificial Sequence; identical to SEQ ID NO: 95345
  derived and/or modified sequence opt2 from hemagglutinin__InfluenzaA__ADM14930
